United States Patent 11,446,398 (REGULATED BIOCIRCUIT SYSTEMS) - sequence listing, part 38

SEQ ID NO: 124739 - DNA, 9483 bp, Homo sapiens
  Payload ID: 4493
  Gene Symbol: CPEB4
  Gene Name: cytoplasmic polyadenylation element binding protein 4
  Uniprot ID: Q17RY0
  ENST ID: ENST00000265085
  CDS Start-End: 1455-3644
agtgctacccccacccctccctcttcgaaccggaagtgtctctgggtctttccagctggttgtcatttcactcggctcggtcctgaggagaaggactcagccgcggctgcgggacccgggcaccgggaggcggtggcggcggcggcggcggcagcagcggcgacagcagaggaggaagaggaggaagaaggaaagaaaaagaagaaccaggaggagtcctcaacaacgacagcggggactgcgggaccagggtaaagcggcgacggcggcgacggcccagcaaccgtgaggagaaacaaaagccttctaaattatagtttaaaaaaaaattctgggggaaaagagagagaaagccgaggggggaggcccttctcctttaaaataactacggtagtgggtttttcctttttttcctcttttttccctctctgcggagaatcgaactgagggaactgaacaaaccgcccctgggtcccatgagggaaaaaaaccccggagccgcagagaggggaagaggcagaaaccgcaggaccttccaggtcgccccctcggtccccgcacccccaggccgcccgctcaccctcgtcgagtctcgctaatccctcctgatcgcgacccccgcaagagggagaaacgggtgtttccaacccctttcatgggggagaggaagccgcggggagcccaggaacagcgaccgcagcaagatctgcacccggagcctcaggaacagccccagaggccaaaactgcaccctgcgaaagagcagaaaacaggaccaggaacagcagaaacctccctgcaatcatctttccattagtcaatgctgatttcctctcccgaaaccaggaattcacttcccaccccagataacctaatataatctatatatataaatatataatatataatgttcttaaattattcctgatttttttttaaccaagctgccaagaaaagaacgtattcccctcttagtcctattctaatttttatgtgagtgaatctaaactgctgaggaaaaccatatgtgattgttaaattatatatatctatatttttactccgcgcaaggcttattcttctacatccatagatgcttgagaagctctgtttttgtcattcatgtacattttcctttggaaaaagaaagcgcctattttactaaccaaagacttgatttttaccctcttcatttttattccctcctaaaaataagcccaattggatccaagtcaatgttttaagagatttttttaagagttgttttttctttcagagaccagaattccaaatcagaacaatttaaggtgataagctgcgatctttgagctagctataaataagacatttcaagcaagcaagcaaacaacttaaatttggggtagaggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtcgtctaaactattcatatccaggatccgatagctctctgcttattaatgcaaggacatatgggcgaaggagaggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaactaaaataacattacagtttccgaatttagcatgggacatagtcagtgtttgaagtgccaacttcatcaagtaatgcatgctttattataaataaaattctagctttgaaaggcgttatgtgttgaacagtatgcttcaggggtaaatttaaaatagtctcttgaagccctagtcatggaagtaacttttattttaattgacattctcttattaaatgccctatccatcattaaaaggtttattatcagtgggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgatttaaaacttgaatgtgatgaattgtggcaagttaacttcaagttatgtgcaatacttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaagtgaaacttttagcaagtgggtgtctagtttttactaatccctaattttttttccagtgtattgctcatattatcagaaggaaaagttatttaagtatgtcagttaattgtactacttggctgaatttccatatagtttttactgtgtatggggaggttgtagtatttattatagcattttaaataagggtaattcattttttattaaagtcattttcacgttaagttcctatttttgtatgttctactcttaagttatataacacagttccttttttaaaagagttcatttgttgaagtgctagtgaaaaattaatgttattaaatagtttgcaaatgactatttataccagtatgcatataatttttaaatatttgtaatgtgagatgttgaatgaataaaacttttaactcagatttcttttaatatacttatttctttttaacacaagtagatgatgctttcttgactgggaatgtaacattttaaaatattaggaatatactgttcagctaatgcagcacaaaccaataggaaaaaatcttcagtcatataagtactgtggccagtgtgcattcttatgtaagcctataagcgtcggtgggtggttgtgtctttggcctgtactgttagttcacctgctgcctgccctgcagagttctttttatttgtagccttcaatatgtatacagggagtaagcccaggatctaagcattcagttatcagttgaaggccaaatgcccaacaaaagtgaaaaacccaatgtttagttaataatgaaagtccgtatctgggaggttcagttttgagtctttgtcaatgaatagtcttgatttgtggccacactaccaaagggcttgaaaacaagtctcttttgacttccaattcccagttcctccatagaccttaatgtcataggatacggtgtgtgggattataatctctatggcatgtcaattgaaaatattatctttgatttgatccattaatcatgtggactaccaagtgctgtaatgtgttagtatttatattttaaactgcattctcaaacttttaacataaggatttattataacaaaatataacactgagaatatcctgttttgtcagatttaatatctgttctttcttgagtatagtattctcaagactagaagaggttcttgtcctgagagaaatggactatgagatcttttgcgtctaagttgtctttcccaacaggcagctcttctaactatagagattactgagggtaagggcaggctggacagcttcccctttctctcatctggcaattcccaaaccttacgttgagcattcaatgaagggccttgaggaaaccccagggatgggacactggagatgtgggtggcatttggttatcaagtctataatattcctaggcattctgggatggtttcactattttaagaaaagaaaaaaaagatagcccaagcatatttagtttattttaggaaatgtttatttcaggtaagtgagatatcaatgatatgtgatataacaactctatcttgaaattacataggtgcattgctttgggtgttttaaatcacagaatggtgtgtctggaaagggtgtaagaggcttcctgggctatatttcttcattcactgattgcctaaacctacccaacgaggaaaattctttttatttttatcttttgtttttactgtctaaccagatgaataaacagtggaaattctctaccacactcttaacaatcaagtcatttcataaccccttttggtaatgggtgtttgtgtccacagctagatcagaaagtaagtactttttctagggatttttttttttttttaagtttgggaaatagtttgatcaaaagtcatggggaaagtaatctctgattttaaaaattgaagaatactgaaggtgtcagtgagttagaaatttttaaggagtaattattttctgaaatgtgtaataaccgaataataaacaagacaaaactctaatatttcagactgtgatcttcagaggactaggatagtcctttccacaagaaaaagacaaaaaaaaataaagttttaccattaaataca

SEQ ID NO: 124740 - DNA, 6705 bp, Homo sapiens
  Payload ID: 4493
  Gene Symbol: CPEB4
  Gene Name: cytoplasmic polyadenylation element binding protein 4
  Uniprot ID: Q17RY0
  ENST ID: ENST00000334035
  CDS Start-End: 395-2533
ctccgcgcaaggcttattcttctacatccatagatgcttgagaagctctgtttttgtcattcatgtacattttcctttggaaaaagaaagcgcctattttactaaccaaagacttgatttttaccctcttcatttttattccctcctaaaaataagcccaattggatccaagtcaatgttttaagagatttttttaagagttgttttttctttcagagaccagaattccaaatcagaacaatttaaggtgataagctgcgatctttgagctagctataaataagacatttcaagcaagcaagcaaacaacttaaatttggggtagaggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaagcaaggacatatgggcgaaggagaggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaactaaaataacattacagtttccgaatttagcatgggacatagtcagtgtttgaagtgccaacttcatcaagtaatgcatgctttattataaataaaattctagctttgaaaggcgttatgtgttgaacagtatgcttcaggggtaaatttaaaatagtctcttgaagccctagtcatggaagtaacttttattttaattgacattctcttattaaatgccctatccatcattaaaaggtttattatcagtgggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgatttaaaacttgaatgtgatgaattgtggcaagttaacttcaagttatgtgcaatacttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaagtgaaacttttagcaagtgggtgtctagtttttactaatccctaattttttttccagtgtattgctcatattatcagaaggaaaagttatttaagtatgtcagttaattgtactacttggctgaatttccatatagtttttactgtgtatggggaggttgtagtatttattatagcattttaaataagggtaattcattttttattaaagtcattttcacgttaagttcctatttttgtatgttctactcttaagttatataacacagttccttttttaaaagagttcatttgttgaagtgctagtgaaaaattaatgttattaaatagtttgcaaatgactatttataccagtatgcatataatttttaaatatttgtaatgtgagatgttgaatgaataaaacttttaactcag

SEQ ID NO: 124741 - DNA, 1416 bp, Homo sapiens
  Payload ID: 4493
  Gene Symbol: CPEB4
  Gene Name: cytoplasmic polyadenylation element binding protein 4
  Uniprot ID: Q17RY0
  ENST ID: ENST00000517880
  CDS Start-End: 128-1096
gagagctagcagtggggtgatttgaaagtcacaagagaaataaatgatttgaaaaaaatctctatgacaagaaactcctaattgggttttgaaaaagtctaaagaagatcgccccaggacattcgacatgcactcactggagagttcactcattgacataatgagagctgaaaatgataccattaaaggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaa

SEQ ID NO: 124742 - DNA, 2257 bp, Homo sapiens
  Payload ID: 4493
  Gene Symbol: CPEB4
  Gene Name: cytoplasmic polyadenylation element binding protein 4
  ENST ID: ENST00000519835
  CDS Start-End: 204-2123
ttttaagagttgttttttctttcagagaccagaattccaaatcagaacaatttaaggtgataagctgcgatctttgagctagctataaataagacatttcaagcaagcaagcaaacaacttaaatttggggtagaggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtaagccttatactacattttggaaaattctagaaatggtcctctaaatgtgtgattaccaatattagaacgggagcattttatgacaataaagtgacagctgacaattttgcctatagagttaattatggtctataatacatgaaataatgtcctatgaatttctt

SEQ ID NO: 124743 - DNA, 2607 bp, Homo sapiens
  Payload ID: 4493
  Gene Symbol: CPEB4
  Gene Name: cytoplasmic polyadenylation element binding protein 4
  ENST ID: ENST00000520867
  CDS Start-End: 395-2509
ctccgcgcaaggcttattcttctacatccatagatgcttgagaagctctgtttttgtcattcatgtacattttcctttggaaaaagaaagcgcctattttactaaccaaagacttgatttttaccctcttcatttttattccctcctaaaaataagcccaattggatccaagtcaatgttttaagagatttttttaagagttgttttttctttcagagaccagaattccaaatcagaacaatttaaggtgataagctgcgatctttgagctagctataaataagacatttcaagcaagcaagcaaacaacttaaatttggggtagaggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtcctttt

SEQ ID NO: 124744 - DNA, 441 bp, Homo sapiens
  Payload ID: 4493
  Gene Symbol: CPEB4
  Gene Name: cytoplasmic polyadenylation element binding protein 4
  ENST ID: ENST00000519152
  CDS Start-End: 1-441
gagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtcgtctaaactattcatatccaggatccgatagctctctgcttattaatggtcagtcttcactgtttccaatggaagatggattcttggatgatggccgtggggatcagcctcttcatagtggcctgggttcacctcactgcttcagtcaccagaatggggaaagagtggaacgat

SEQ ID NO: 124745 - DNA, 1551 bp, Homo sapiens
  Payload ID: 4493
  Gene Symbol: CPEB4
  Gene Name: cytoplasmic polyadenylation element binding protein 4
  ENST ID: ENST00000522336
  CDS Start-End: 155-1174
gagagcacacgcacacatgtatgaggagagagctagcagtggggtgatttgaaagtcacaagagaaataaatgatttgaaaaaaatctctatgacaagaaactcctaattgggttttgaaaaagtctaaagaagatcgccccaggacattcgacatgcactcactggagagttcactcattgacataatgagagctgaaaatgataccattaaaggtcgtctaaactattcatatccaggatccgatagctctctgcttattaatggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaa

SEQ ID NO: 124746 - DNA, 3375 bp, Homo sapiens
  Payload ID: 4494
  Gene Symbol: CKAP2
  Gene Name: cytoskeleton associated protein 2
  Uniprot ID: Q8WWK9
  ENST ID: ENST00000258607
  CDS Start-End: 119-2167
ggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtgtaatt

SEQ ID NO: 124747 - DNA, 1972 bp, Homo sapiens
  Payload ID: 4494
  Gene Symbol: CKAP2
  Gene Name: cytoskeleton associated protein 2
  Uniprot ID: Q8WWK9
  ENST ID: ENST00000378034
  CDS Start-End: 119-1603
ggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcaggtaagataaaaatttactgatctttacaattacagtgtagtagacaattcggaattaatttgaaacacatcacaacataacttgagaaaattttctttgtatatgtagtggtaataaatgtttaaaggctgcaaggattgcattataaaagctgtttgttggctttctaagtcttttattcctgtattgggaataatcagattttagaaaatggatataagctgaaatgtatatttaatgaaactttctgcatgaaatgttttagcatattattgtatgcatttcctggttggaagtttactgggagactgaatgtaatattaaaatttgtttattgaatataaagcaaaagggattaaattcgctttttaaatgtta

SEQ ID NO: 124748 - DNA, 3629 bp, Homo sapiens
  Payload ID: 4494
  Gene Symbol: CKAP2
  Gene Name: cytoskeleton associated protein 2
  Uniprot ID: Q8WWK9
  ENST ID: ENST00000378037
  CDS Start-End: 91-2142
ttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccagtagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtgtaattatgttttaatgaagtttatttcaacagatattttatgaaatgcagtttaaccacagtgaatgaattttagctttgcttttgaaatacattgtaagatttgacttgaggtttttgacacttaagtacatgcttaatgatatattttcaaaagtcatcagtctacttacataaactttacctaatttttttcactttaacaaaaacataactatgcccttgttttttcatactttgacccaaaatatgccattttgaaataaaatttaagctttgatacac

SEQ ID NO: 124749 - DNA, 3395 bp, Homo sapiens
  Payload ID: 4494
  Gene Symbol: CKAP2
  Gene Name: cytoskeleton associated protein 2
  Uniprot ID: Q8WWK9
  ENST ID: ENST00000490903
  CDS Start-End: 283-2187
tgcgcctgcgctgggtcctccgcctcttaggtccctagcgaatttctgcagggctggggtcgcatcatgtgttatttccaatttcacagcttctccttcgactttatggaaaccgagggttggttgggtcttcaaaactaatattgttattcccttattctacacacgggaaagcagaagaaagtaattctcatctaacccagttctgagcaaagaagacaaaaactcaaggaacatctgttgagaagaaaaacgctttttgcatacaagcaggaaaatgagatgttatccagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttggatcttatcgtggccagattgttcagtctaagattaattcatttagaaaacctctacaagtcaaagatgagagttctgcagcaacaaagaaactttcagccactatacctaaagccacaaaacctcagcctgtaaacaccagcagtgtaacagtgaaaagtaatagatcctccaatatgactgccactactaaatttgtgagcactacatctcagaacacacaacttgtgcgacctcctattagaagtcatcacagtaatacccgggacactgtgaaacaaggcatcagtagaacttctgccaatgttacaatccggaaagggcctcatgaaaaagaactattacaatcaaaaacagctttatctagtgtcaaaaccagttcttctcaaggtataataagaaataagactctatcaagatccatagcatctgaagttatagccaggcctgcttcattgtctaatgataaactgatggaaaagtcagagcccgttgaccagcgaagacatactgcaggaaaagcaattgttgatagtagatcagctcagcccaaagaaacctcggaagagagaaaagctcgtctgagtgagtggaaagctggcaaaggaagagtgctaaaaaggccccctaattcagtagttactcagcatgagcctgcaggacaaaatgaaaaaccagttgggtctttttggactaccatggcagaagaagatgaacaaagattatttactgaaaaagtaaacaacacattttctgaatgcctgaacttgattaatgagggatgtccaaaagaagatatactggtcacactgaatgacctgattaaaaatattccagatgccaaaaagcttgttaagtattggatatgtcttgcacttattgaaccaatcacaagtcctattgaaaatattattgcaatctatgagaaagccattctggcaggggctcagcctattgaagagatgcgacacacgattgtagatattctaacaatgaagagtcaagaaaaagctaatttaggagaaaatatggagaagtcttgtgcaagcaaggaagaagtcaaagaagtcagtattgaagatacaggtgttgatgtagatccagaaaaactggaaatggagagtaaacttcatagaaatttgctatttcaagattgtgaaaaagagcaagacaacaaaacaaaagatccaacccatgatgttaaaacccccaatacagaaacgaggacaagttgcttaattaaatataatgtgtctactacgccatacttgcaaagtgtgaaaaaaaaggtgcagtttgatggaacaaattccgcatttaaagagctgaagtttttaacaccagtgagacgttctcgacgtcttcaagagaaaacttctaaattgccagatatgttaaaagatcattatccttgtgtgtcttcattggaacagctaacggagttgggaagagaaactgatgcttttgtatgccgccctaatgcagcactgtgccgggtgtactatgaggctgatacaacataagagaaataaagctctgttagggaatggggtttttattatttgtggggtgttttgttttgagtagctttatattgctcttaggtctggagttggccatgtacctatgtatcctaagcattcacggcagtgagctcctttactaacattcatgttatggcaagagttgtcctctacattggaaagctaatcctaccttgtcagtttcaaccaactgagttttttctttaagaaaggtaaattttgtcagctagtttactatgttccttgaatataaacaggttataatactaccctgttcactttactaaatataagtacagtaatgatgcataattagaaaatgaggtattctaggtaaaatgtatgtttgccttgacatgtttttaaaagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaaatgtcattctagtttagatagcatttctaagataactgatactaatacttgttttcttccctataacataaaaaacttcactgttaagtcatgtcccttgaaacatgatagttacatacacagttttctctccacacataaataacaccactaaagttgttttgtaaggttccaaactaatatggcatatatcaactctacagtttcaaataaatgactttttaattgtaaaagattagttgaaaaactgtatgaatgtgaagatcacatgcttagtcatttttatgttcattccactttgtatatcttttctatttattgacttctcatgttctagagagtaggacttttattccgtgtacctgatatatatacaattaaaatatctgtgtaatt

SEQ ID NO: 124750 - DNA, 537 bp, Homo sapiens
  Payload ID: 4494
  Gene Symbol: CKAP2
  Gene Name: cytoskeleton associated protein 2
  ENST ID: ENST00000480747
  CDS Start-End: 247-537
agcgaatttctgcagggctggggtcgcatcatgtgttatttccaatttcacagcttctccttcgactttatggaaaccgagggttggttgggtcttcaaaactaatattgttattcccttattctacacacgggaaagcagaagaaagtaattctcatctaacccagttctgagcaaagaagacaaaaactcaaggaacatctgttgagaagaaaaacgctttttgcatacaagcaggaaaatgagatgttatccagtagtagagatcagagagttgtgacatctgaggaccaagttcaagaagggactaaagtgctgaaacttaaaacaaaaatggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagc

SEQ ID NO: 124751 - DNA, 579 bp, Homo sapiens
  Payload ID: 4494
  Gene Symbol: CKAP2
  Gene Name: cytoskeleton associated protein 2
  ENST ID: ENST00000468284
  CDS Start-End: 299-579
accaatgggcggagacggcagccgcgccgtctgacggcttagccgcggtgcagactgcggcggcggtggtctgaggaagttctatcttggcgctaaagcggagacgcatcccccgacccgaggctacgatgagcacaccggccgtgccccaggacctgcagctgcccccgagtcagagggcgcagtccgcattcaaagagcaaagaagacaaaaactcaaggaacatctgttgagaagaaaaacgctttttgcatacaagcaggaaaatgagatgttatccaggctgataaagaaaacatgaagagacctgcagagagcaaaaataatacagtggtggggaaacattgtattcctttaaaaccttcaaatgaactaaccaattcaactgtagtaattgacacacataaacctaaggatagtaatcaaactccgcatttgttactaactgaagatgatccccaaagtcaacatatgacattaagccaggcatttcaccttaaaaacaatagtaaaaagaaacaaatgactacagaaaaacaaaagcaagatgctaacatgcccaagaaacctgtgcttgg

SEQ ID NO: 124752 - DNA, 4533 bp, Homo sapiens
  Payload ID: 4495
  Gene Symbol: CKAP2L
  Gene Name: cytoskeleton associated protein 2-like
  Uniprot ID: Q8IYA6
  ENST ID: ENST00000302450
  CDS Start-End: 80-2317
aatgaggacgcgtggacgcgcggcacgccggtcctggctacaggcgcggcgtttgaagaaaaactgtcactgaagagtcatggtggggcccgggcctaccgctgctgccgctgtcgaagagcggcagagaaagcttcaggagtaccttgcagccaagggaaaactgaagagccaaaacaccaagccttatctaaaatccaagaataattgccagaatcaaccaccttctaaatctactattagacccaaaaatgatgttaccaaccatgttgttttgcctgtcaaacctaaaaggtccatcagcattaaactccagcccagaccacctaatactgcagggtcccagaagccgaagttggagccaccaaaacttctgggcaaaaggctgacttcagaatgtgtttcttctaacccatactctaagccttctagcaagagttttcaacagtgtgaagctggatcgtccacaacaggagaactgtcaagaaaacctgtggggtcacttaatatagagcaattgaaaactacaaagcagcagttaacagatcaaggaaatggtaaatgtatagactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttgttggagaaacacaaagcaggactttcccagtaaaatcacagcaactctctagaggagcagatcttgcaagaccaggagtaaaaccctcaaggacggttccctctcactttattcggacccttagtaaagttcagtcatcaaagaaaccagtagtcaagaacatcaaagatataaaggttaataggagtcaatatgaaagaccaaatgaaactaagatacggtcataccctgttactgaacagagagtgaagcacaccaaacccagaacataccccagtttgcttcagggtgaatataacaacagacatccaaacatcaagcaagatcagaagtccagccaagtttgtatacctcagacatcatgtgtactgcaaaagtcaaaagccataagccagaggcctaatttgacagttggcagatttaattcagccattccaagcacccctagcataagaccaaatggaaccagtggtaataaacataacaataatggctttcagcaaaaagcacagactttggactccaagttgaaaaaggctgttccccagaaccattttctgaacaagacagctcccaaaactcaagctgatgtcacaaccgtaaatgggacccaaacaaacccaaatattaaaaagaaggcaacagcagaggatcgaaggaaacaactagaagaatggcagaaatctaagggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgttattgggctatatgaagaggccattaaaaatggggcaacaccaatacaagagttgcggaaagttgttcttaatatcttgcaagactcaaacagaaccacagaagggattacttctgactctttagttgctgaaactagtataacatcagtggaagagctggccaagaagatggaatctgtgaagtcttgtctttctccaaaagagagggaacaagtcacggcgacaccccgaatagccaaggcagaacagcataattatcctggtatcaaattacagattggtccaatccctagaataaatgggatgccggaagtgcaagacatgaaatttatcactcctgtacggcgttcgtcgaggattgagcgagcagtgtcccgctacccagaaatgctgcaggaacacgatttagtagtggcttctcttgatgaactgttagaagtggaagaaacaaaatgttttatattccgtagaaatgaggcgctgcctgtaacattggggtttcaaacccctgaatcataatttcttgatgctttttttaaaaaaggtgtttcagaaccaacataagacaagaaatattcttgtccaagtgacctggaaaaaaagagaggcatcatggatgcagattatggacgctcaggacttaagtaattcactgggcttactctcaaattttctctccccatgggaaaatctttgctttatgtgtttaagaccagtttgccagttttacagtatacataaatttcaaacttttgaatatttaccctacaactatgataaatatttatactttattgatctactttaatcccaacatagttttttatatcagaaggttggtcccacaatataatgggacttttctttctgcatccaccttagcagagggcaagttctttcatcgtggaagatctgaactttgacgctagcttgacaggctgaatggaccttgacagatggccaagtcaaaacccctcattttacagatgagtttatgctagctgtgcctttgctcagagatcataaatttatgtgtgatctttgactttcatcacagtatccttgtaaatgagagagaattcttgttttttctatgccaggtctcctcagatgaaacacaatcctgaattggcatggtcgtctagcttttatattcaaacctagttttgcatttgttactcagaaacacttcaagtaacaaaaggggggcaggggagaggggtggggagtggacacttgcttcttcagttctttgctcagctagggtatagctggcctgagaaggcagtgcaagccccagagactgttgtaggttgctttttcttcctcctgggcaactatttgtggaaaggttttaccttagtcattatgtaaatataattgtgtagaaaaacctagtcaacacattttaaattttagctttcttaatatttaagtattatcttaaaacaacattaaatttctattagttcctgcttgtttatcttatttattatagaaaaccatgataatggctttgcatagagaattaggagtttgtctaaggatataccagttggctgtcctaagaaacaaggagcattcattaccaaggagaatggactttgatcaaaggtctatcagcctcatccaggaactagatttttttaagggaagcagatctatttctgaaagtcagatttataataaagctcaaaaaactgagctataaacctgtaataccagcagactttcaataagagactcttacaactcaattgtggaaaaactaataattaaaaatgggcaaaggacctgagcagacatttctccaaagaagacataagaaatggccagtaggtatagatatgaaaaggtgttcagcatcattaatcataagaataatgtaaattaaaaccactgtgagctatcacctcacatctataagaatggctattaacaagacatgagataaatgttgatgagattgtggagaaaagagaaccctagtacactgtttgtgggcgtgtagactggggcagccgttatggaaaacggtatggaggctcctaaagaaattaaaaatagaactgttatctgaccctcttctgagtaagtatgtacccaaagaagatgaaatcaccagctgggcgcagtgactcacacctgtaatcccagcactttggagtgggtgaatcacctgaggtcaggagttcaagaccagcttgaccaacatggtgaaaccccgtctctactaaaaatacaaaaagtaggcgggcatggtgacgggcacctgtaatcccagctacttgggaggctgaggcagaagaatcacttgaactcgggaggtggaggttgcagtgagccaaaattgcgtcactgcactccagcctgggttacagagcaagactccatctcaaaaaaaaaaaagatgaaatcatcacctcataaagatatctgcactcacatgtttgtggcagtgttattctcaatagccaagatgtggaaacaacctaaatgcccatcaatggacaaataaagaaaatacggcatatgcatgccgtggaatagtattcatccttggaaaagagggagttcttgccatttgccacaacatagatggacctggagaacattatgctaagtgaaataagccagacccaaggaaaaatactgcatgatctcacatatggaatatttaattttttaagaaagagctcaagtacacagagaaagtgcttaccacagattgggga

SEQ ID NO: 124753 - DNA, 2455 bp, Homo sapiens
  Payload ID: 4495
  Gene Symbol: CKAP2L
  Gene Name: cytoskeleton associated protein 2-like
  ENST ID: ENST00000435431
  CDS Start-End: 20-586
aaactgtcactgaagagtcatggtggggcccgggcctaccgctgctgccgctgtcgaagagcggcagagaaagcttcaggagtaccttgcagccaagggaaaactgaagagccaaaacaccaagccttatctaaaatccaagaataattgccagaatcaaccaccttctaaatctactattagacccaaaaatgatgttaccaaccatgttgttttgcctgtcaaacctaaaaggtccatcagcattaaactccagcccagaccacctaatactgcagggtcccagaagccgaagttggagccaccaaaacttctgggcaaaaggctgacttcagaatgtgtttcttctaacccatactctaagccttctagcaagagttttcaacagtgtgaagctggatcgtccacaacaggagaactgtcaagaaaacctgtggggtcacttaatatagagcaattgaaaactacaaagcagcagttaacagatcaaggaaatgcaaaaagcacagactttggactccaagttgaaaaaggctgttccccagaaccattttctgaacaagacagctcccaaaactcaagctgatgtcacaaccgtaaatgggacccaaacaaacccaaatattaaaaagaaggcaacagcagaggatcgaaggaaacaactagaagaatggcagaaatctaagggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgttattgggctatatgaagaggccattaaaaatggggcaacaccaatacaagagttgcggaaagttgttcttaatatcttgcaagactcaaacagaaccacagaagggattacttctgactctttagttgctgaaactagtataacatcagtggaagagctggccaagaagatggaatctgtgaagtcttgtctttctccaaaagagagggaacaagtcacggcgacaccccgaatagccaaggcagaacagcataattatcctggtatcaaattacagattggtccaatccctagaataaatgggatgccggaagtgcaagacatgaaatttatcactcctgtacggcgttcgtcgaggattgagcgagcagtgtcccgctacccagaaatgctgcaggaacacgatttagtagtggcttctcttgatgaactgttagaagtggaagaaacaaaatgttttatattccgtagaaatgaggcgctgcctgtaacattggggtttcaaacccctgaatcataatttcttgatgctttttttaaaaaaggtgtttcagaaccaacataagacaagaaatattcttgtccaagtgacctggaaaaaaagagaggcatcatggatgcagattatggacgctcaggacttaagtaattcactgggcttactctcaaattttctctccccatgggaaaatctttgctttatgtgtttaagaccagtttgccagttttacagtatacataaatttcaaacttttgaatatttaccctacaactatgataaatatttatactttattgatctactttaatcccaacatagttttttatatcagaaggttggtcccacaatataatgggacttttctttctgcatccaccttagcagagggcaagttctttcatcgtggaagatctgaactttgacgctagcttgacaggctgaatggaccttgacagatggccaagtcaaaacccctcattttacagatgagtttatgctagctgtgcctttgctcagagatcataaatttatgtgtgatctttgactttcatcacagtatccttgtaaatgagagagaattcttgttttttctatgccaggtctcctcagatgaaacacaatcctgaattggcatggtcgtctagcttttatattcaaacctagttttgcatttgttactcagaaacacttcaagtaacaaaaggggggcaggggagaggggtggggagtggacacttgcttcttcagttctttgctcagctagggtatagctggcctgagaaggcagtgcaagccccagagactgttgtaggttgctttttcttcctcctgggcaactatttgtggaaaggttttaccttagtcattatgtaaatataattgtgtagaaaaacctagtcaacacattttaaattttagctttcttaatatttaagtattatcttaaaacaacattaaatttctattagttcctg

SEQ ID NO: 124754 - DNA, 6532 bp, Homo sapiens
  Payload ID: 4496
  Gene Symbol: CKAP5
  Gene Name: cytoskeleton associated protein 5
  Uniprot ID: Q14008
  ENST ID: ENST00000312055
  CDS Start-End: 127-6045
aataaagaacgaggacactgcggggtgtgcggcggcccaagcggtttcaaacggcttagagcaggccgcttggttctgacccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctg

SEQ ID NO: 124755 - DNA, 6428 bp, Homo sapiens
  Payload ID: 4496
  Gene Symbol: CKAP5
  Gene Name: cytoskeleton associated protein 5
  Uniprot ID: Q14008
  ENST ID: ENST00000354558
  CDS Start-End: 27-5945
aattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactata

SEQ ID NO: 124756 - DNA, 498 bp, Homo sapiens
  Payload ID: 4496
  Gene Symbol: CKAP5
  Gene Name: cytoskeleton associated protein 5
  ENST ID: ENST00000527333
  CDS Start-End: 1-498
acgcaagggaccagctgaggacatgtcttccaaactcaaaattatgtatcgcacttataggatccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagctaagactcatctacaacacacacatggcagatgagaaattggagaaggacgagatcatcaagttgtatagctgtatcattggcaacatgatttcgctgtttcagatagagagccttgcccgggaggcctccactggagt

SEQ ID NO: 124757 - DNA, 7121 bp, Homo sapiens
  Payload ID: 4496
  Gene Symbol: CKAP5
  Gene Name: cytoskeleton associated protein 5
  Uniprot ID: Q14008
  ENST ID: ENST00000529230
  CDS Start-End: 48-6146
cccagctgaggaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaacccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgtgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggagtcattgtggcacaagtatttgtacatactctgcttctctctgtcagcgtcctgctgctctagaagactgtccgtggatgagtttagtgtacagacttgtaaacagctgccccctctctgctcagtctagttcccagatccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatgcatggcatgatacaactaatttaagagtcttttataaataaagtttgcattaactatacctgactcccaagatgctccatatcatggagtgttgggcagcaattttttaacttttggtaccagctgggtattcagccagttagagaaaggttaattactgcttacagagcttccctttttcttggctcacagacttggagctgtcttttattcctttggaatggaaggaactctccttccctgctctccacaaacagctcctagggagcagaaaaatctcatccttccttgttttgagattttggtcatgatttccctccaattatcaccagtcgtttcaagaagctcttgggcatcctaccactttgctgaccaaaggcacacaagattgcgcccagagattggctgggcttcagtggttctcacactacaactagatttgtgttcatttgactaatggagtttgggaaatcttagtggtttgctgcttggttgtatgagtctcttttggtccaggctaacagttgcttcacattcagtcagagtaagg

SEQ ID NO: 124758 - DNA, 832 bp, Homo sapiens
  Payload ID: 4496
  Gene Symbol: CKAP5
  Gene Name: cytoskeleton associated protein 5
  ENST ID: ENST00000525896
  CDS Start-End: 1-610
cctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagaaaagggagcatctcgaatagatgaaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaaggtactgctccttttcttctgtgcagttcagggagggtagtcacaagcaggtccgaggcaggctggcccacagagaagtggcttagtcttgctgtagttctggagctgcatcttgacctgcttgacctgaccttagacaatctctctccttctctcaatagcaagatgaccgacctcctttgacctctttgctctccaaaccagcagttcctactgtcgcctcttccacagacatgctccacagcaaactctctcagctccg

SEQ ID NO: 124759 - DNA, 570 bp, Homo sapiens
  Payload ID: 4496
  Gene Symbol: CKAP5
  Gene Name: cytoskeleton associated protein 5
  ENST ID: ENST00000526876
  CDS Start-End: 1-570
ataagctccaatgccaacatgttacgcaagggaccagctgaggacatgtcttccaaactcaaaattatgtatcgcacttataggatccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagatcgatgaggtcctgagacaggaagacaaagctgaagccatgtccggccatattgatcagtttctgatagccacttttatgcagctaagactcatctacaacacacacatggcagatgagaaattggagaaggacgagatcatcaagttgtatagctgtatcattggcaacatgatttcgctgtttcag

SEQ ID NO: 124760 - DNA, 582 bp, Homo sapiens
  Payload ID: 4496
  Gene Symbol: CKAP5
  Gene Name: cytoskeleton associated protein 5
  ENST ID: ENST00000526496
  CDS Start-End: 130-582
aatgctgctgccgccgccgccgccgcctgccgggtattcctgctgatcctgctcggaccttagcttccctgacctctccctgcccggggagcgaaatactcttaattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagcc

SEQ ID NO: 124761 - DNA, 3093 bp, Homo sapiens
  Payload ID: 4497
  Gene Symbol: CKAP4
  Gene Name: cytoskeleton-associated protein 4
  Uniprot ID: Q07065
  ENST ID: ENST00000378026
  CDS Start-End: 138-1946
gtcctctcgccgctccgacgccagcagcgcccgcgtgccgctcgcccagtcccgggggagcccctgcaagtttcccgggccgcgcgccgcgctcgctcgcctcccagcccgcggcccgagccgccgccgcgcccgccatgccctcggccaaacaaaggggctccaagggcggccacggcgccgcgagcccctcggagaagggtgcccacccgtcgggcggcgcggatgacgtggcgaagaagccgccgccggcgccgcagcagccgccgccgccgcccgcgccgcacccgcagcagcacccgcagcagcacccgcagaaccaggcgcacggcaagggcggccaccgcggcggcggcggcggcggcggcaagtcctcctcctcctcctccgcctccgccgccgctgccgccgccgccgcctcgtcctcggcgtcctgctcgcgcaggctcggcagggcgctcaactttctcttctacctcgccctggtggcggcggccgctttctcgggctggtgcgtccaccacgtcctggaggaggtccagcaggtccggcgcagccaccaggacttctcccggcagagggaggagctgggccagggcttgcagggcgtcgagcagaaggtgcagtctttgcaagccacatttggaacttttgagtccatcttgagaagctcccaacataaacaagacctcacagagaaagctgtgaagcaaggggagagtgaggtcagccggatcagcgaagtgctgcagaaactccagaatgagattctcaaagacctctcggatgggatccatgtggtgaaggacgcccgggagcgggacttcacgtccctggagaacacggtggaggagcggctgacggagctcaccaaatccatcaacgacaacatcgccatcttcacagaagtccagaagaggagccagaaggagatcaatgacatgaaggcaaaggttgcctccctggaagaatctgaggggaacaagcaggatttgaaagccttaaaggaagctgtgaaggagatacagacctcagccaagtccagagagtgggacatggaggccctgagaagtacccttcagactatggagtctgacatctacaccgaggtccgcgagctggtgagcctcaagcaggagcagcaggctttcaaggaggcggccgacacggagcggctcgccctgcaggccctcacggagaagcttctcaggtctgaggagtccgtctcccgcctcccggaggagatccggagactggaggaagagctccgccagctgaagtccgattcccacgggccgaaggaggacggaggcttcagacactcggaagcctttgaggcactccagcaaaagagtcagggactggactccaggctccagcacgtggaggatggggtgctctccatgcaggtggcttctgcgcgccagaccgagagcctggagtccctcctgtccaagagccaggagcacgagcagcgcctggccgccctgcaggggcgcctggaaggcctcgggtcctcagaggcagaccaggatggcctggccagcacggtgaggagcctgggcgagacccagctggtgctctacggtgacgtggaggagctgaagaggagtgtgggcgagctccccagcaccgtggaatcactccagaaggtgcaggagcaggtgcacacgctgctcagtcaggaccaagcccaggccgcccgtctgcctcctcaggacttcctggacagactttcttctctagacaacctgaaagcctcagtcagccaagtggaggcggacttgaaaatgctcaggactgctgtggacagtttggttgcatactcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttt

SEQ ID NO: 124762 - DNA, 573 bp, Homo sapiens
  Payload ID: 4497
  Gene Symbol: CKAP4
  Gene Name: cytoskeleton-associated protein 4
  ENST ID: ENST00000553039
  CDS Start-End: 495-573
atttgaaagcactcctcccacacttgctggtctgttttgttttaatacctgtgcttccccctctggggccctcaacctctcacaaaatggcattgaagctgcttccacacatgactgggtatcttcggccctgggcctcttcaaatcaggcaacttccactggctgtcagggtgatgcatgaaatccctagagaagagaggaaaaggaccacggcagggagcctcctcaagtgggaaccactgagattaactcattatccgttggcagagagggcttctcactctattgcccaggctgatgtgcagtagccattcactggtgagatcatcacgcgctacagcatcaaactcctggcctcaagtgatccccctgcctcagcctccgaagtagctgggattacaggagtgaaacttgtgcacaggaaggcttcccttcctccagagagaacactggaggccactcaccttccagaccaccaaatttaacatcactcatgccagctggaggaggccccagatccctctggccagtgaagttttggttggtgcagtctttgcaagccacatttggaa

SEQ ID NO: 124763 - DNA, 1533 bp, Homo sapiens
  Payload ID: 4498
  Gene Symbol: CIAO1
  Gene Name: cytosolic iron-sulfur assembly component 1
  Uniprot ID: O76071
  ENST ID: ENST00000488633
  CDS Start-End: 220-1239
ccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactata

SEQ ID NO: 124764 - DNA, 2087 bp, Homo sapiens
  Payload ID: 4499
  Gene Symbol: CTU1
  Gene Name: cytosolic thiouridylase subunit 1
  Uniprot ID: Q7Z7A3
  ENST ID: ENST00000421832
  CDS Start-End: 46-1092
atcccagcactgagttctgcccgggagaagccgacccctcccgcaatgcccgccccgccgtgcgcctcctgccatgctgcacgcgccgccctccgccgtccgctctcgggccaagcgctgtgcggtgcctgcttctgcgccgccttcgaggccgaggtgctgcacacggtgctcgccggccgcctgctgccgcccggcgcggtggtggccgtgggcgcctcgggcggcaaggactccacggtgctggcgcacgtgctgcgcgcgctggcgccgcgcctgggcatctcactgcagctcgtggccgtcgatgagggcatcggtggctaccgggacgcggcgttggcggccgtgcggcgccaggcggcgcgctgggagctgccgctcacggtcgtggcctacgaagacctctttgggggctggacgatggacgccgtggcccgcagcacagccggctccggccgcagccgctcctgctgcaccttctgtggagtgctgcggcgccgggcgctggaggaaggggcgcgccgcgtgggagccacgcacatcgtgacaggtcacaacgccgacgacatggcggagaccgtgctcatgaacttcctacggggcgacgcggggcggctggcccggggcgggggcctgggctctcccggcgaggggggcgccctgccgcgctgccgcccgctgcagttcgcctcgcagaaggaggtggtgctgtacgcgcacttccgccgcctcgactacttctccgaggagtgcgtctacgcgcccgaggccttccgcggccacgcccgggacctgctcaagcgcctggaggcggcgcggccgtccgcggtgctggacctcgtgcactcggccgagcgcctggcgctggccccggccgcgcggcccccgcgccccggcgcctgctcccgctgtggggcgctggccagccgcgcgctctgccaggcctgcgcgctcctggacggcctgaaccgcggccggccccgcctggccatcggcaagggccgccggggtctggacgaggaggcgacgccggggacgcccggggatccggcccggccccccgcctccaaggccgtccccaccttctagcgacttcgggcctcccgccgggatctgatgccgcggggtgggggctgcctgtaaatgacactgtgaataaacccgttaccttacctggccttccatgtggggttgggaaggagacgggggcccattcacctgaaaccctgaagaagctgggaccccagacttcgaggtctcagggaagaagggtctcgaactgggcttcaggctctgagggaggagggggctgggggaccatcctaggtctgagagaggagagggccaggactaagcctagaagaagtgggactggggaccccaggcatctgtggctgaggaaggagggcctggggtcgtggactcctgggtctcagggaggagggggctgaacaccgtgtgattcttgagcgagtggggattggttggggacctcctgcccagggcctctgctggttctgggtgcgctcagcatggtcctgaccctccttgagcatcagattcctgatgtttcctgtttgcccgcagtggggtaagcggagcgtgacttgatggacacacgccattcacagccgccgtcacgatgcctcccttccagcgcttcgtgtgtagcacgcactgcaccctcatttcgtctccaccacggtctcactggctgtagcctgaagtggtaaatggccctaagacacccagtcggaaggggtcacaccgagggctccctccaaagctctcgaatatcacaggtcgtggaattggtcctcccccacccatcccctctcgaatctctcctggtatctctgtcacgggtgaggaggggttggatgcgttccccaaaccttggactctggaggcagggttgtgtgagcctgtcggtgacttagcctctttcatgtcccatttctcctatgaaaatataatcagcccccttcccccccgcccccccatcccccccgcatcaaggcaccactgggaggaaatggaagatcagagaagttgaggtgctcaataaatggtgaccacttgga

SEQ ID NO: 124765 - DNA, 1672 bp, Homo sapiens
  Payload ID: 4500
  Gene Symbol: CTU2
  Gene Name: cytosolic thiouridylase subunit 2 homolog (S. pombe)
  Uniprot ID: Q2VPK5
  ENST ID: ENST00000312060
  CDS Start-End: 49-1506
gccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccagatgcagtcacccatccccctgactgagacccggacacccccggggccctgctgttctccaggggtgggctgggcccagcgctgtggccagggggcctgcaggagggaggacccccaagcctgcattgaggagcagctgtgctacagctgccgcgtgaacatgaaggacttgggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaa

SEQ ID NO: 124766 - DNA, 1751 bp, Homo sapiens
  Payload ID: 4500
  Gene Symbol: CTU2
  Gene Name: cytosolic thiouridylase subunit 2 homolog (S. pombe)
  Uniprot ID: Q2VPK5
  ENST ID: ENST00000453996
  CDS Start-End: 69-1616
ctccgacgtcatcggggcgcgccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccagatgcagtcacccatccccctgactgagacccggacacccccggggccctgctgttctccaggggtgggctgggcccagcgctgtggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaa

SEQ ID NO: 124767 - DNA, 1586 bp, Homo sapiens
  Payload ID: 4500
  Gene Symbol: CTU2
  Gene Name: cytosolic thiouridylase subunit 2 homolog (S. pombe)
  ENST ID: ENST00000564105
  CDS Start-End: 49-258
gccctcgcgctgtcgccgccacagtctgcgacgggacccggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccagatgcagtcacccatccccctgactgagacccggacacccccggggccctgctgttctccaggggtgggctgggcccagcgctgtggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggca

SEQ ID NO: 124768 - DNA, 931 bp, Homo sapiens
  Payload ID: 4500
  Gene Symbol: CTU2
  Gene Name: cytosolic thiouridylase subunit 2 homolog (S. pombe)
  ENST ID: ENST00000564921
  CDS Start-End: 663-931
cgcggcccaggtaagagctggcggccggacccgccaggccgcccctcgccttcccgccgcactcctgccccgaagggtcccggccgggcttgctccgggaagccccgcgtggagagcgggacctcgctccctagcactcggggaatgcctgtcaagcggtgacggccacctagaaggggacttactccactggctcgcgcctctcatcctagcagccactggggacggctctgccgctgacagtgctgtccttattcggagagaactggtgccgtgaagctgtctcgcctccccgtgtcagccttgggagactgaaaagcggcctttatgtgccccctgagccggcttttctaggctaaacatccccccagagcctttgtttttcttgaagtttggacagaacacaagcctgggtttgtgtgtgtaccgaggtgcctttctctgacccaactcagggtgagaaacaggagctgtctccccaaagcccactaggcgtggggaagatgtgatctgtgtttctctcttctcccccctcccatctccaaagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgagggagcagcctgtggccagagcctagaggagagatcaaagaccctggccgaagtgaagcccattctgcaagcaactgggttcccatggcatgtggtggccttagagga

SEQ ID NO: 124769 - DNA, 452 bp, Homo sapiens
  Payload ID: 4500
  Gene Symbol: CTU2
  Gene Name: cytosolic thiouridylase subunit 2 homolog (S. pombe)
  ENST ID: ENST00000567316
  CDS Start-End: 1-327
tgctgttctccaggggtgggctgggcccagcgctgtggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagaggtactggggcccacactgccgtggcgcgtgggtaaggggcctcggggctggtgcccactgcagctttctctctagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaatt

SEQ ID NO: 124770 - DNA, 1905 bp, Homo sapiens
  Payload ID: 4500
  Gene Symbol: CTU2
  Gene Name: cytosolic thiouridylase subunit 2 homolog (S. pombe)
  ENST ID: ENST00000567949
  CDS Start-End: 10-1770
ggcgtgcccatgtgtcaggtgggcgaggactacggggagccggcgcctgaggagccgcccccggcgccgcggcccagccgtgagcagaagtgtgtgaagtgcaaggaagcgcagcccgttgtggtgatacgagccggagatgccttctgcagggactgtttcaaggccttctacgtccacaagttcagagccatgctgggcaagaaccggctcatctttccaggcgagaaggtgctcttggcgtggtctggggggccttcgtccagctccatggtctggcaggttcttgagggcctgagccaagattctgccaaaagactgcgctttgtggcaggagtcatctttgttgacgaacgaactcctggggtgttgactgtagcgctgaggtcagccgcaagagagaaacccctgcccaaaggaaaatggccgacaccccacagctccgccaggaagcaccgccctgcggagcgaggcctcgaagggttttcccaggtggaggtggccctgcagcctgccctgcctggctcctctctgagccctgactctttctgcctgggtttttcagagggagcagcctgtggccagagcctagaggagagatcaaagaccctggccgaagtgaagcccattctgcaagcaactgggttcccatggcatgtggtggccttagaggaggtgttcagcctgccaccgtcggtgctttggtgctctgcccaggagctggtgggatccgagggggcctacaaggcggccgtggacagcttcctccagcagcagcatgtgctgggggccgggggtggtcctggcccgactcaaggggaggaacagccaccccagcccccgctggacccccagaacctggcaagaccgcctgcccctgcccagactgaggctctttcccaactgttctgctcagtgaggacactgactgccaaggaggagcttctgcagaccctgcggacccacctgatcctccacatggcccgagcccacggctactccaaggtcatgactggggacagctgcacacgcttggctatcaagctcatgaccaacctggcgctgggtcgaggggccttcctggcctgggatacgggcttctcggatgagcggcacggggacgtggtggtggtgcggcccatgcgggaccacaccctgaaggaggtcgctttctacaaccgcctgttctccgttccttctgtcttcacaccagccgtcgacaccaaggcccctgaaaaggccagcatccaccggctgatggaggccttcatcctcaggctgcagacccagttcccctccactgtcagcactgtgtacaggacaagtgagaagctggtgaagggcccccgggatggccctgctgctggcgactccggcccccgctgcctcctctgcatgtgtgccctggacgtcgacgccgctgacagtgccacggcttttggggctcagacctcctcgcgtctctcccagatgcagtcacccatccccctgactgagacccggacacccccggggccctgctgttctccaggggtgggctgggcccagcgctgtggccagggggcctgcaggagggaggacccccaagcctgcattgaggagcagctgtgctacagctgccgcgtgaacatgaaggacttgccctcactggaccccctgccgccgtacatcctggctgaggcccagctccgcacacagagggcctggggcttgcaggagatccgggactgtctgattgaggacagtgacgacgaggcgggccagagctgagcgtgaggacgtgcttgccgggacagcaggcagtggccacctggtacaccacactggagccggaaggcaaggacgggggactggcctctgattgtccatttgtataaataaaacattttttaattaaaaaaaaaa

SEQ ID NO: 124771 - DNA, 2469 bp, Homo sapiens
  Payload ID: 4501
  Gene Symbol: CRTAM
  Gene Name: cytotoxic and regulatory T cell molecule
  Uniprot ID: O95727
  ENST ID: ENST00000227348
  CDS Start-End: 48-1229
agaatctagaggaagttgacaaaggtgccacagcagcacagcacagtatgtggtggagagttctcagcttgctggcatggttccccttgcaagaggcctctctgactaaccacacagaaaccatcaccgtggaggaaggccagacgctcactctaaagtgtgtcacttctctgaggaagaactcctccctccagtggctgaccccctcagggttcaccatttttttaaatgagtatcctgctttaaaaaattccaaataccagcttcttcatcactcggccaatcagctctccatcactgtgcctaacgtaaccctgcaagatgaaggcgtgtacaagtgcttacattacagcgactctgtaagcacaaaggaagtgaaagtgattgtgctggcaactcctttcaagccaatcctggaagcttcagttatcagaaagcaaaatggagaagaacatgttgtactcatgtgctccaccatgagaagcaagccccctccgcagataacctggctacttgggaatagcatggaagtgtccggtggaacgctccatgaatttgaaactgatgggaagaaatgtaatactaccagcactctcataatccacacttatggcaaaaattcaacggtggactgcattatccgacacagaggcctgcaagggagaaaactagtagcacccttccggtttgaagatttggttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgtttaaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgcactccagcctgggcaacagagggagactctgtctcaaaaaaaaagaagttacttccaagacagacttttaagatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagttatacttcctgttttcacgtgtgaaagtaacatgggacatgcctttcttttccgatcagtttatttaagctatacagcaaactttggcatttatgtggagcatttctcattgttggaatctgaataaaccaattacaaaataa

SEQ ID NO: 124772 - DNA, 1929 bp, Homo sapiens
  Payload ID: 4501
  Gene Symbol: CRTAM
  Gene Name: cytotoxic and regulatory T cell molecule
  Uniprot ID: O95727
  ENST ID: ENST00000533709
  CDS Start-End: 107-691
aaaaaccagagcaggagccacagaacacacagttctggggtttctgcacaacctctacaagcaggtagccgctaaatatattctccaatctcttttactgagcacaatgtgggtaaaactgctctctatagtagcagaattttgtttttcccctttcctagttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtagtgctctctgcaatggaacatgtgatttcagggttgccgcagtgtcacctcagtggaccagcctgggggaaggagcttaattgctgagacattaataatgacctcttagtgcaatgcaagatggtgtcctcggataatgatctgccccggagctagggcagcaacatgaggaccaaaccatgcacataaagcttgtagtttaaaaaagaaaagcaaaaaaataattatgcctgacactacttcagagcaggaggattctacgaagccttggggatcagggtcagtgtgagcagctaacatcctacctcaaatggaacaggattttttgatgctttgctctaatggaactgtttaaaaaatttttttttctttttaatattttcttctggtcacaaaataaagaaatttgggatgcaaagtacctaaagatctctgatcctaagaagttacttctggccaggcgcggtggctcatgcctgtaatcctagcactttgggaggctgaggtaggcagatcacttgaggtcaggagttggagaccagcctggccaacatagtgaaaccccgtctctactaaaaatgcaaaaattagccaggcgtagtggtgcgcacctgtagtctcagatacttgggaggctgagggtggagaatcgcttgaacctgggaggtggagattgcagtgagtcaagatctcaccactgcactccagcctgggcaacagagggagactctgtctcaaaaaaaaagaagttacttccaagacagacttttaagatgtaaccagcacaaagcaatgtcagggaggagtgatacatgacaataaatgagtcagatgagcaagaaggccccagaacccatgccccaaggcacaaagaggagctcagggtaggcccaaagattcgaattccttagattactaaatcacatgagcggaccttgtctgtcagataagatttttacctggaaattccatgaccaatacatgtgcaaaagaaaatgatgggttgaatttactgattattgacctaatggatggctttttaaaatgttttaataaaaagcagaatagatgtttgtttttctagtggttataccaagttatacttcctgttttcacgtgtgaaagtaacatgggacatgcctttcttttccgatcagtttatttaagctatacagcaaactttggcatttatgtggagcatttctcattgttggaatctgaataaaccaattacaaaat

SEQ ID NO: 124773 - DNA, 525 bp, Homo sapiens
  Payload ID: 4502
  Gene Symbol: CTLA4
  Gene Name: cytotoxic T-lymphocyte-associated protein 4
  Uniprot ID: P16410
  ENST ID: ENST00000295854
  CDS Start-End: 1-525
atggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtga

SEQ ID NO: 124774 - DNA, 1977 bp, Homo sapiens
  Payload ID: 4502
  Gene Symbol: CTLA4
  Gene Name: cytotoxic T-lymphocyte-associated protein 4
  Uniprot ID: P16410
  ENST ID: ENST00000302823
  CDS Start-End: 158-829
gccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 124775 - DNA, 969 bp, Homo sapiens
  Payload ID: 4502
  Gene Symbol: CTLA4
  Gene Name: cytotoxic T-lymphocyte-associated protein 4
  ENST ID: ENST00000427473
  CDS Start-End: 146-559
tctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcacaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgaga

SEQ ID NO: 124776 - DNA, 277 bp, Homo sapiens
  Payload ID: 4502
  Gene Symbol: CTLA4
  Gene Name: cytotoxic T-lymphocyte-associated protein 4
  Uniprot ID: P16410
  ENST ID: ENST00000472206
  CDS Start-End: 1-240
atggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtctaaagaaaagaagccctcttacaacaggggtctatgtgaaaatgcccccaacagagccagaatgtgaaaagcaatttcagccttattttattcccatcaattga

SEQ ID NO: 124777 - DNA, 2229 bp, Homo sapiens
  Payload ID: 4503
  Gene Symbol: DBP
  Gene Name: D site of albumin promoter (albumin D-box) binding protein
  Uniprot ID: Q10586
  ENST ID: ENST00000222122
  CDS Start-End: 445-1422
ttgctttggccacgcctcaaggcggccgcctcctcctgccccctcctccgcccctccgcgcacacctctcggtgcagattgcaaagcgccttccgttgcgagagctgcagattttgcaagagccaggctcgcccaccttgtagaaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgcccgcccctgggcagacactcgtccaaaccactggagtgtgctggtgactggcaggccagcccttcgcctctccatgaacccgtgagcctgggggcaggtgccaggcgatggcgcggcctgtgagcgacaggaccccggcccctctgctgctgggcggcccggccgggacaccccctggcgggggagcgctgcttgggttgcggagccttctgcaggggaccagcaagcccaaagagccggccagctgtctcctgaaggaaaaggagcgcaaggcggccctgcctgcagccacaacccctgggccaggcctggagactgcgggcccggcggatgccccggctggggcagtggtgggcggagggtccccgcgggggcgcccggggccggtgcccgccccgggtctgttggcgccactgctgtgggagcgcacgctgccgttcggcgatgtggagtacgtagacctggacgccttcctgctggagcacgggctcccgcccagcccgccgccccccggtggcccgtcgccggagccgtcgcccgcgcggacgcccgcaccctccccagggccgggttcgtgcggctcggcttccccccgctcctctcctgggcacgcccccgcccgggctgccctcgggaccgccagcggccaccgcgcaggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggatgagaaatactggagccggcggtacaagaacaacgaggcagccaagcggtcccgtgacgcccggcggctcaaggagaaccagatatcggtgcgggcggccttcctggagaaggagaacgccctgctgcggcaggaagttgtggccgtgcgccaggagctgtcccactaccgcgccgtgctgtcccgataccaggcccagcacggggccctgtgaggctgccccacatccccacctggcggagctctcctccgccttgctgagacttacgccctgttcccttcctgccctgtggcccacgggccggccagctgggtgccccagggacgtgataatgcagataaatacatttatatttttaagaaaaagcgagcctcccccctcccttgcgggggcggggagggttctctgtgtgtgtccccggcacgtcagggaccctatcctcccaccgcctccgttaacacgatcctgaataaatcttgagaaccccagagccagctgttgtggaagaagagggcagctccctggcatactggctgcagcccgtgggcagctccgggctgtcgtccatagagggcaggcgctgctggaagtgctggagtctgagtcctcccgcgggctgtcggatggaggaagggcagaaggtctgagaggaatgaagcgactgcctttattgcatagaccttttcaattgctttttagattggggacggaggacgcgcatgagacgaacaggggatatgaatttccccgcccccacccgcggggagaggaacattagtgcaaatcctagcgccggccccggggaacctgcccctcctgggctgattggccagctaaatggaggcaccggagtggatggggcgaggctgcgggccctgaccggccgactcactgaggcctaccccagccagtacattccaggtcctgtcattgggcgacgcgtaaaatagactccgccctcagccatcctggccgggtaggagcaggtggcaagcgtcaggactgagccctgccccgtaa

SEQ ID NO: 124778 - DNA, 1489 bp, Homo sapiens
  Payload ID: 4503
  Gene Symbol: DBP
  Gene Name: D site of albumin promoter (albumin D-box) binding protein
  ENST ID: ENST00000601104
  CDS Start-End: 370-1158
agattgcaaagcgccttccgttgcgagagctgcagattttgcaagagccaggctcgcccaccttgtagaaggagcgccttgagtcccctctcaccctcggttgcaaagagccgaccgcttgatctggacaccccctcgcccagattgcatgatctcccgggaccctcttgagttgcacgtttctgcaccgaggacctcaaatccccgtcgctcctaggatttgcagcgttctggatactggagggttgcaggctacactcgcccgcccctgggcagacactcgtccaaaccactggagtgtgctggtgactggcaggccagcccttcgcctctccatgaacccgtgagcctgggggcaggtgccaggcgatggcgcggcctgtgagcgacaggaccccggcccctctgctgctgggcggcccggccgggacaccccctggcgggggagcgctgcttgggttgcggagccttctgcaggggaccagcaagcccaaagagccggccagctgtctcctgaaggaaaaggagcgcaaggcggccctgcctgcagccacaacccctgggccaggcctggagactgcgggcccggcggatgccccggctggggcagtggtgggcggagggtccccgcgggggcgcccggggccggtgcccgccccgggtctgttggcgccactgctgtgggagcgcacgctgccgttcggcgatgtggagtacgtagacctggacgccttcctgctggagcacgggctcccgcccagcccgccgccccccggtggcccgtcgccggagccgtcgcccgcgcggacgcccgcaccctccccagggccgggttcgtgcggctcggcttccccccgctcctctcctgggcacgcccccgcccgggctgccctcgggaccgccagcggccaccgcgcaggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggtgagcagagctggatgtgggagatagacttggctggagacatgccccacagccagggaggggccttttctcacagtcaagcctgggcttctccttgggattagtgctcagcctctcctggcctgcagccacagattagtcctccttggccacggggcacaagggggcaggggcctgaggtttataaagacagtgtcaactgggcgaggggcctcactcgtgtaatcccagcattttagggggctgaggcaggaggatctcttgagctcgggagttcaagaccagcctgggcaacatggcaaaaccccatttctacaagccacttgggaggctgaggtgggaggactgcttgtgcctg

SEQ ID NO: 124779 - DNA, 709 bp, Homo sapiens
  Payload ID: 4503
  Gene Symbol: DBP
  Gene Name: D site of albumin promoter (albumin D-box) binding protein
  ENST ID: ENST00000599385
  CDS Start-End: 186-557
gccgggggaacgtgagggcgccgatggcgggggcctgggaggaagggaggaggagggaagcaggcgtcagcacgtgactcggccctgaacctgtgtccttagctggccccggctggctggtgcttaaaggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggatgagaaatactggagccggcggtacaagaacaacgaggcagccaagcggtcccgtgacgcccggcggctcaaggagaaccagatatcggtgcgggcggccttcctggagaaggagaacgccctgctgcggcaggaagttgtggccgtgcgccaggagctgtcccactaccgcgccgtgctgtcccgataccaggcccagcacggggccctgtgaggctgccccacatccccacctggcggagctctcctccgccttgctgagacttacgccctgttcccttcctgccctgtggcccacgggccggccagctgggtgccccagggacgtgataatgcagataaatacatttatatttttaagaaaaa

SEQ ID NO: 124780 - DNA, 712 bp, Homo sapiens
  Payload ID: 4503
  Gene Symbol: DBP
  Gene Name: D site of albumin promoter (albumin D-box) binding protein
  ENST ID: ENST00000593500
  CDS Start-End: 235-606
ggctggctggtgcttaaaggtacaggcgcctcctttcgaaccaatcttctggaaccttagagcagcttctcctcctctttccagcgagtagctcttagactctaacttgagagcttttcagtgcagtagattctttttctctggacagtctggggtctaagcttaggtcgtggattcggcctgacctctcgggacacacccagccctgtggacccagacaccgtggaggtgttgatgacctttgaacccgacccagctgatcttgccctatcaagcattcctggccacgagacctttgaccctcgaagacatcgcttctcagaagaggaacttaagccccagccaatcatgaagaaggcaagaaaaatccaggtgccggaggagcagaaggatgagaaatactggagccggcggtacaagaacaacgaggcagccaagcggtcccgtgacgcccggcggctcaaggagaaccagatatcggtgcgggcggccttcctggagaaggagaacgccctgctgcggcaggaagttgtggccgtgcgccaggagctgtcccactaccgcgccgtgctgtcccgataccaggcccagcacggggccctgtgaggctgccccacatccccacctggcggagctctcctccgccttgctgagacttacgccctgttcccttcctgccctgtggcccacgggccggccagctgggtgcccc

SEQ ID NO: 124781 - DNA, 2617 bp, Homo sapiens
  Payload ID: 4504
  Gene Symbol: D2HGDH
  Gene Name: D-2-hydroxyglutarate dehydrogenase
  Uniprot ID: Q8N465
  ENST ID: ENST00000321264
  CDS Start-End: 210-1775
ttcggccgctgggcggagccgtcaatgcgcaggcgcggcgtcgccccgcccactccggctcggcggctctgggcctgcggcgggcgctgcgggttggagctcgggacgtgatcgtgggcgcgcagccagcggctccctgcccttcccctccgggccctgagtaccggccccccaccaaggaggagcccgaggtctccgtcccggcggcgatgctgccccgtcggcctctggcgtggcccgcgtggctgttgcggggtgctccgggagccgcgggttcttggggtcggccggttggccccctggcccgcagaggctgctgctccgccccggggacccccgaggtgccgctgacccgggagcgctaccccgtgcggcgcttgccgttctccacggtgtctaagcaggacctggccgcctttgagcgcatcgtgcccggcggggtcgtcacggacccggaagcgctgcaggctcccaacgtggactggttgcggacgctgcgaggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggaattctggtttgccaggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcacgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgcaa

SEQ ID NO: 124782 - DNA, 2277 bp, Homo sapiens
  Payload ID: 4504
  Gene Symbol: D2HGDH
  Gene Name: D-2-hydroxyglutarate dehydrogenase
  ENST ID: ENST00000400769
  CDS Start-End: 159-1121
actccggctcggcggctctgggcctgcggcgggcgctgcgggttggagctcgggacgtgatcgtgggcgcgcagccagcggctccctgcccttcccctccgggccctgagtaccggccccccaccaaggaggagcccgaggtctccgtcccggcggcgatgctgccccgtcggcctctggcgtggcccgcgtggctgttgcggggtgctccgggagccgcgggttcttggggtcggccggttggccccctggcccgcagaggctgctgctccgccccggggacccccgaggtgccgctgacccgggagcgctaccccgtgcggcgcttgccgttctccacggtgtctaagcaggacctggccgcctttgagcgcatcgtgcccggcggggtcgtcacggacccggaagcgctgcaggctcccaacgtggactggttgcggacgctgcgaggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggaattctggtttgccaggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcgatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcacgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgc

SEQ ID NO: 124783 - DNA, 2208 bp, Homo sapiens
  Payload ID: 4504
  Gene Symbol: D2HGDH
  Gene Name: D-2-hydroxyglutarate dehydrogenase
  ENST ID: ENST00000403782
  CDS Start-End: 205-1368
aatgcgcaggcgcggcgtcgccccgcccactccggctcggcggctctgggcctgcggcgggcgctgcgggttggagctcgggacgtgatcgtgggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggaattctggtttgccaggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcacgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgc

SEQ ID NO: 124784 - DNA, 955 bp, Homo sapiens
  Payload ID: 4504
  Gene Symbol: D2HGDH
  Gene Name: D-2-hydroxyglutarate dehydrogenase
  ENST ID: ENST00000445308
  CDS Start-End: 1-955
aaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccccgtggcccacccaccatgtccttccctcccctgtggcccacccgccatgtccctgcctcccacccgacatgccccttgagctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtcccccttctgtgaggtgtcccagccgcctgattgccggagtcccagggtgctcggtgctgtcgtggagcctgggacattcactgtctgggattgattccaggatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagcca

SEQ ID NO: 124785 - DNA, 454 bp, Homo sapiens
  Payload ID: 4504
  Gene Symbol: D2HGDH
  Gene Name: D-2-hydroxyglutarate dehydrogenase
  ENST ID: ENST00000417686
  CDS Start-End: 1-454
ccacagcgtgtctggaattctggtttgccaggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcggttttctgtgttctgctctgatcccactccaactgcagtcacctgtgtgccgcccgcctgtggtcctgggagcccga

SEQ ID NO: 124786 - DNA, 566 bp, Homo sapiens
  Payload ID: 4504
  Gene Symbol: D2HGDH
  Gene Name: D-2-hydroxyglutarate dehydrogenase
  ENST ID: ENST00000432449
  CDS Start-End: 1-566
ttctgtgttctgctctgatcccactccaactgcagtcacctgtgtgccgcccgcctgtggtcctgggagcccgaggccagcccggctgccgcatcctgctcttcgcactccaggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttg

SEQ ID NO: 124787 - DNA, 4549 bp, Homo sapiens
  Payload ID: 4504
  Gene Symbol: D2HGDH
  Gene Name: D-2-hydroxyglutarate dehydrogenase
  ENST ID: ENST00000436747
  CDS Start-End: 174-905
ggcgtcgccccgcccactccggctcggcggctctgggcctgcggcgggcgctgcgggttggagctcgggacgtgatcgtgggcgcgcagccagcggctccctgcccttcccctccgggccctgagtaccggccccccaccaaggaggagcccgaggtctccgtcccggcggcgatgctgccccgtcggcctctggcgtggcccgcgtggctgttgcggggtgctccgggagccgcgggttcttggggtcggccggttggccccctggcccgcagaggctgctgctccgccccggggacccccgaggtgccgctgacccgggagcgctaccccgtgcggcgcttgccgttctccacggtgtctaagcaggacctggccgcctttgagcgcatcgtgcccggcggggtcgtcacggacccggaagcgctgcaggctcccaacgtggactggttgcggacgctgcgaggctgtagcaaggtgctgctgaggccacggacgtcggaggaggtgtcccacatcctcaggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggcgggctgcgtcctggaggagctgagccggtatgtggaggaacgggacttcatcatgccgctggacttaggagccaagggcagctgccacatcgggggaaacgtggcaaccaacgctggaggcctgcggtttcttcgatatggctcactgcatgggactgtcctgggcctggaagtggtgctggccgacggcactgtcctggactgcctgacctccctgaggaaggacaacacgggctatgacctgaagcagctgttcatcgggtcggagggcactttggggatcatcaccacggtgtccatcttgtgtccacccaagcccagggctgtgaacgtggctttcctcgtcacctgtgtgccgcccgcctgtggtcctgggagcccgaggccagcccggctgccgcatcctgctcttcgcactccaggtctcagacaggagtcactcgcctcttcgtgccacgcccacgtctaagccgggtggaacaggccctgtgaggatggtcctggtgtccctcgtgctcgtgggctcggtccagctctccagggccccagtcagccctggctcctgctctcctgcagctggggcgacttccgacgaggcactcttgtcccacttcctggggattcctgcccactctgagcaagatgcccagtccccaccgccagaccctccaacaccaccaccacctcccacaccccagccctctacgcgtctgcagccacaccccgacatggtgctcgggtcacaggccttgaggtgctcctgtgtcacccagtgcaggtgtctgcccccagcctctgcgcctgtgagaccttctctctggaaaattcttctctgatatccacatgcctttgcattgcctccctgtctcgccctgaaaggtgggcacgggccccctcctgctgcagcgtctctggggctgcccgcctgcagacatctccactcagttcctttccatctttgcacttgagggtcggcttccccagggcagcggcctcactggtagcccccaccaaccctggagcactaacacgcctgttggatgaggtcctgagtgcagggaagacctgagtgctgattgtgttaagagaaatgcagccattcccaaaggctgcctgttgctggctctgtgtttgcagaattcccaagatacgccccctctgagtcccactgccgtctcaggtgctgtgtggttcttcggcgccttcccctcctgatttgatgctggtggtgacaccaggcgtgcacctgtccctcctgatctgatgctggtgacaccaggcgtgcacctgcccctcctggcatctgatgctggtggtgacaccaggcgtgccctgcccctcctgatctgatgctggtggtgacaccaggcgtgcaccttctcctgatctgatgctggtggtgacactaggctgcccaggctttgctgaggttctgcagaccttcagcacctgcaaggggatgctgggtgagatcctgtctgcattcgagttcatggatgctgtgtgcatgcagctggtcgggcgccatctccacctggccagcccggtgcaagagagtccgttttacgtcctcatcgagacttcaggctccaacgcaggccatgacgctgagaagctgggccacttcctggagcacgcgctgggctccggcctggtgaccgatgggaccatggccaccgaccagaggaaagtcaagggtctcgctctcacccaggctggagtgcagtgacacagttgcagctcactgcagcctcgacctcctgggctcaagcaatcctcccgcctcagcctcccgagtagctgagtctacagatctccacaatggaagttcgaagcaagcaaaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccccgtggcccacccaccatgtccttccctcccctgtggcccacccgccatgtccctgcctcccacccgacatgccccttgagctgcctgggccctgctgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtcccccttctgtgaggtgtcccagccgcctgattgccggagtcccagggtgctcggtgctgtcgtggagcctgggacattcactgtctgggattgattccagggttggagccacacctggtctggggcattcgctgtcctgggtcagagcccctcctggtctgggacattcgctgtctggggttggagccacacctggtctggggcatttgctgtccggggtcggagcctcacctggtgaagatacagaacatgctgctgccctaaccccgtgtggtgtgccccctgtccccgggtgtcgttcccatagccagcccttgtctcatctcgtctcatcctctagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcacgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgcaa

SEQ ID NO: 124788 - DNA, 234 bp, Homo sapiens
  Payload ID: 4504
  Gene Symbol: D2HGDH
  Gene Name: D-2-hydroxyglutarate dehydrogenase
  ENST ID: ENST00000454048
  CDS Start-End: 1-234
ggcaacacaggcatggtgggtggcagcgtccccgtctttgacgagatcatcctctccactgcccgcatgaaccgggtcctcagcttccacagcgtgtctgagagtccgttttacgtcctcatcgagacttcaggctccaacgcaggccatgacgctgagaagctgggccacttcctggagcacgcgctgggctccggcctggtgaccgatgggaccatggccaccgaccagagg

SEQ ID NO: 124789 - DNA, 269 bp, Homo sapiens
  Payload ID: 4504
  Gene Symbol: D2HGDH
  Gene Name: D-2-hydroxyglutarate dehydrogenase
  ENST ID: ENST00000437164
  CDS Start-End: 1-269
aggcactgccacgagaggaacctggccgtgaacccacaggggggcaacacaggcatggtgggtggcagcgtccccgtctttgacgagatcatcctctccactgcccgcatgaaccgggtcctcagcttccacagcgtgtctggctgcccaggctttgctgaggttctgcagaccttcagcacctgcaaggggatgctgggtgagatcctgtctgcattcgagttcatggatgctgtgtgcatgcagctggtcgggcgccatctccacct

SEQ ID NO: 124790 - DNA, 2294 bp, Homo sapiens
  Payload ID: 4504
  Gene Symbol: D2HGDH
  Gene Name: D-2-hydroxyglutarate dehydrogenase
  ENST ID: ENST00000610344
  CDS Start-End: 436-1044
ggccggattcccagtggtggcgaggaggtggtatttttttaagtgtcagtgtggcattgtggttgcctcaataaaacagagtctttttttgtcttttttttttgagacagggtctcgctctcacccaggctggagtgcagtgacacagttgcagctcactgcagcctcgacctcctgggctcaagcaatcctcccgcctcagcctcccgagtagctgagtctacagatctccacaatggaagttcgaagcaagcaaaagccacgcaaaccacaggccgatctgtctgagccctaggatttggcccggttctgcttcagccaccagcaccgtctgctcctcctcagaatccttcctcccccgtggcccgcccgccgtgtccctcctcctccacggcccgcccaccgtgtccttccctcccccgtggcccacccaccatgtccttccctcccctgtggcccacccgccatgtccctgcctcccacccgacatgccccttgagctgcctgggcccttgttgtccccactgcctgtgtgactctgcgcccccttccctaccctgccccaccctggttcagggagcgtccaggcccattctcatcctcagggccttccctggcccttgccactctgtgccgtgtcatgacctgaagctgcaggtgggcgcctcccccttccgtcatggctgtcccccttctgtgaggtgtcccagccgcctgattgccggagtcccagggtgctcggtgctgtcgtggagcctgggacattcactgtctgggattgattccagggttggagccacacctggtctggggcattcgctgtcctgggtcagagcccctcctggtctgggacattcgctgtctggggttggagccacacctggtctggggcatttgctgtccggggtcggagcctcacctggtgaagatacagaacatgctgctgccctaaccccgtgtggtgtgccccctgtccccgggtgtcgttcccatagccagcccttgtctcatctcgtctcatcctctagatgctgtgggccctgagggaaaggatcacagaggcgctgagccgggatggctacgtgtacaagtacgacctctccctccctgtggagcggctctacgacatcgtgactgacctgcgcgcccgcctcggcccgcacgccaagcacgtggtgggctatggccaccttggagatggtaacctgcacctcaatgtgacggcggaggccttcagcccctcgctcctggctgccctggagccccacgtgtacgagtggacggccgggcagcagggcagcgtcagcgcggagcacggagtgggcttcaggaagagggacgtcctgggctacagcaagccaccgggggccctgcagctcatgcagcagctcaaggccctgctggaccccaagggcatcctcaacccctacaagacgctgcccagccaggcctgacggccactcctgctgctgccaaggcccactgggggtcggcgggtggctctcgggcgggggtgttgcggtggctctgagggatgagccggcagtgggcaggggaccaggcacctggttgaagggactgggagcccgcactggggaactgccggacgcaggccctcgggcaggagcatctggcagagtggggggcgtggcaggcaccctcctttgcagggcgaggtggggcctctgcagccatcctggacaggccggggtggcggcagctttgcccacgtggaagcggggtgggtctcacttgcgtggtggcccctggccccatcttgcctgctgcggcctggggagcaggcgctgggtggtggttctgcctgcttgctgctcgttccccgggcatgcgtgggcagcggggggcatgcgtgggcagcagggggcgtgggcagcgggggcacgggcaggaccacgtgggccgtgatcgtgggttgccgagaggacctgagcgctgcggctctgctgaatggagccgggtccctcaggccgtggacgccctcgggaggggggtgactgtggcttgtgtctggacaggaatgtgtcatttcccacatcttctagagggctgccagctgggaagacagttatcagggcaagctgtgctctgagtttcgggttctgctcctacaaagaacgtgcggtgctgcgggcgagggccccggcacggacaagggccactgcagagtgtgtttctgctcgtcagctgccctgggcagcggatgggctgggcgatgcagctggatgcacatctcattctgtcatgaatgtccagtaaaaatctgaattggttgc

SEQ ID NO: 124791 - DNA, 1632 bp, Homo sapiens
  Payload ID: 4505
  Gene Symbol: DPF1
  Gene Name: D4, zinc and double PHD fingers family 1
  Uniprot ID: Q92782
  ENST ID: ENST00000355526
  CDS Start-End: 28-1272
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaa

SEQ ID NO: 124792 - DNA, 2341 bp, Homo sapiens
  Payload ID: 4505
  Gene Symbol: DPF1
  Gene Name: D4, zinc and double PHD fingers family 1
  ENST ID: ENST00000416611
  CDS Start-End: 125-1321
cgcagccccaagaatgaatgaaatcgtagcgcgctgggcggcagagcgggcggcgcaggccgggctgggcccgcgcgcggcggcagcggcgccccgggccggaggcggcccagccgagcgggccatggccaccgccattcagaacccgctcaagtccctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgtt

SEQ ID NO: 124793 - DNA, 1960 bp, Homo sapiens
  Payload ID: 4505
  Gene Symbol: DPF1
  Gene Name: D4, zinc and double PHD fingers family 1
  Uniprot ID: Q92782
  ENST ID: ENST00000414789
  CDS Start-End: 601-1599
gacatgcttgtgtctttggatgcatgagggggtgtatgtgtgtgtggtgtgatgtttccatgttgtgtgtctttgtgtgggtgatgtgtttctggtgtgtgtctgtggatatgtgatgtgtctttgtgcatggttatttgtgtgatttgtctccacactatggaacttgggatatttgtctttttcagtagatatttatgtgtgcacgtgtgtgaggtttgtctgtttctcctttgtgagtattgggatttgtctctctttgtgtgtgaatcccgtgtgactgtgtgtgatttgtgttgtgtgtctgcatgtgttcaggtagggatacgtcccggtgtgtttttgtttgtttctgtatcgtgtttctactcatgagctgggggcctgtttgagtcccagtttgggggcccctgggccctgtccccttcccccagcctgggtcccggagtgggaggaggggagagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaag

SEQ ID NO: 124794 - DNA, 2227 bp, Homo sapiens
  Payload ID: 4505
  Gene Symbol: DPF1
  Gene Name: D4, zinc and double PHD fingers family 1
  Uniprot ID: Q92782
  ENST ID: ENST00000420980
  CDS Start-End: 28-1170
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgataagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgcccacga

SEQ ID NO: 124795 - DNA, 523 bp, Homo sapiens
  Payload ID: 4505
  Gene Symbol: DPF1
  Gene Name: D4, zinc and double PHD fingers family 1
  ENST ID: ENST00000438365
  CDS Start-End: 228-523
gtgcatggttatttgtgtgatttgtctccacactatggaacttgggatatttgtctttttcagtagatatttatgtgtgcacgtgtgtgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcga

SEQ ID NO: 124796 - DNA, 1608 bp, Homo sapiens
  Payload ID: 4505
  Gene Symbol: DPF1
  Gene Name: D4, zinc and double PHD fingers family 1
  ENST ID: ENST00000418517
  CDS Start-End: 84-386
cagagcgggcggcgcaggccgggctgggcccgcgcgcggcggcagcggcgccccgggccggaggcggcccagccgagcgggccatggccaccgccattcagaacccgctcaagtcgcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaa

SEQ ID NO: 124797 - DNA, 1562 bp, Homo sapiens
  Payload ID: 4505
  Gene Symbol: DPF1
  Gene Name: D4, zinc and double PHD fingers family 1
  ENST ID: ENST00000456296
  CDS Start-End: 88-1254
gcggcagagcgggcggcgcaggccgggctgggcccgcgcgcggcggcagcggcgccccgggccggaggcggcccagccgagcgggccatggccaccgccattcagaacccgctcaagtccctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggca

SEQ ID NO: 124798 - DNA, 2303 bp, Homo sapiens
  Payload ID: 4505
  Gene Symbol: DPF1
  Gene Name: D4, zinc and double PHD fingers family 1
  Uniprot ID: Q92782
  ENST ID: ENST00000412732
  CDS Start-End: 251-1249
gcggcagagcgggcggcgcaggccgggctgggcccgcgcgcggcggcagcggcgccccgggccggaggcggcccagccgagcgggccatggccaccgccattcagaacccgctcaagtcgcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacgaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgccca

SEQ ID NO: 124799 - DNA, 973 bp, Homo sapiens
  Payload ID: 4505
  Gene Symbol: DPF1
  Gene Name: D4, zinc and double PHD fingers family 1
  ENST ID: ENST00000438060
  CDS Start-End: 343-973
gtctctgacaagaatggtgtcggatgcaccgctccctggcggggtggagggcgtggggggcctccagattctttttggggaagggagacatcatcccttccctgcaaccctcgggtctgggagagactgaaatgacccgggggtgcgggggccttggcaactggagtgaagtccacactacctttgtcttgggatgtggagtgtgtcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacg

SEQ ID NO: 124800 - DNA, 428 bp, Homo sapiens
  Payload ID: 4505
  Gene Symbol: DPF1
  Gene Name: D4, zinc and double PHD fingers family 1
  ENST ID: ENST00000586624
  CDS Start-End: 266-428
tcttgcttcctcttcgggatcccggactccacgttggtggatctacaggcgatggggcccctcaccctgaccctggcccagacccctgggaggaggtgtgctacagccgtgagcaggggcccagctacacctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtg

SEQ ID NO: 124801 - DNA, 2356 bp, Homo sapiens
  Payload ID: 4505
  Gene Symbol: DPF1
  Gene Name: D4, zinc and double PHD fingers family 1
  ENST ID: ENST00000614244
  CDS Start-End: 109-1302
gtgctcccgccccccgggaatgaatggatgggcggcctcagcgcccgcccgaccgctgggaggaccgacccggcggggacctgctgggggcaggacccggggagcaagatggccactgtcatccctggccccctgagcctaggcgaggacttctaccgcgaggccatcgagcactgccgcagttacaacgcgcgcctgtgcgccgagcgcagcctgcgactgcccttcctcgactcgcagaccggcgtggcccagaacaactgctacatctggatggagaagacccaccgcgggccgggtttggccccgggacagatttacacgtaccccgcccgctgttggaggaagaaacggagactcaacatcctggaggaccccagactcaggccctgcgagtacaagatcgactgtgaagcacccctgaagaaggagggtggcctcccggaagggccggtcctcgaggctctactgtgtgcagagacgggggagaagaagattgagctgaaggaggaggagaccattatggactgtcagaaacagcagttgctggagtttccgcatgacctcgaggtggaagacttggaggatgacattcccaggaggaagaacagggccaaaggaaaggcatatggcatcgggggtctccggaaacgccaggacaccgcttccctggaggaccgagacaagccgtatgtctgtgatatctgtgggaaacggtataagaaccggccggggctcagctaccactacacccacacccacctggccgaggaggagggggaggagaacgccgaacgccacgccctgcccttccaccggaaaaacaaccataaacagttttacaaagaattggcctgggtccctgaggcacaaaggaaacacacagccaagaaggcgcccgacggcactgtcatccccaacggctactgtgacttctgcctggggggctccaagaagacggggtgtcccgaggacctcatctcctgtgcggactgtgggcgatcaggacacccctcgtgtttacaattcacggtgaacatgacggcagccgtgcggacctaccgctggcagtgcatcgagtgcaaatcctgcagcctgtgcggaacctccgagaacgacggtgccagctgggcgggtctcaccccccaggaccagctgctgttttgtgatgactgcgatcggggttaccacatgtactgcctgagtccccccatggcggagcccccggaagggagctggagctgtcacctctgtctccggcacctgaaggaaaaggcttctgcttacatcaccctcacctaggccggctcggctcgccgcgactctggggtggtgctcgcctacctgcctctccgagctcctcaattctcccccaccctgaacatcccgcagggggagggggagagggggaagccgagagggggctgggccaccccctcccctctgtgcaagtggaatgtctgccctgtgggtgggtgggcccggccagggcctctccctccctccctccctctctgtcccttggcaaatggacaccaggggcttctcccctcaaagccataccccgcctctgggcgggcatggggggtggtgggtgccagccaggggcatggacagagcctttttctaaagaaaaagacaaaaagttaaaaaaaaaaaaaagaagaaaagaaaagaagttaatatatacaaagagtcctccaaggcctggctgggtggaggggcgctgctgagagtgtccaccgggcacccgcctctgccggccccccgccgggcgccccaaccccaatttctggagctgcagccgtcccgcgccccacccaaggtgggcgccttcccctcttgtgcccagggcggtgggcgtggtgtccacccgcccctcctggtgcccacggtggatactgcatgatgtgaaccttggttttgaactctgttcctgcccctccccgaccgccccagcctgtgcccgccccgtgcctgccgtggctggtgggtggcggtggtggggccgggtgggcccccgcccagcgcctgctggaatgagaagcacagactccgccacggactccttttctctccctcctcccgccccgccaggcctggcggcccccgcccccctcgctggccattttgggggagtgagggggcgtggttgtttcttgtggttgtgtgtgtttgttgttcgggttttaaaaaagggaaactgagactgcaggtgggggaggtggtgggttttggggggatgtcccctaatccaggagtgccccctcacttgtcaccgagtctcctctattgcctgcctctgctgtgaattaacttgttctgtgtattaaactgggcctgacccctctgccca

SEQ ID NO: 124802 - DNA, 2462 bp, Homo sapiens
  Payload ID: 4506
  Gene Symbol: DPF2
  Gene Name: D4, zinc and double PHD fingers family 2
  ENST ID: ENST00000252268
  CDS Start-End: 21-1238
gaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacaatagtttcaaacaaaagcatacctcgaaagcgccccagagagtttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagagcc

SEQ ID NO: 124803 - DNA, 2085 bp, Homo sapiens
  Payload ID: 4506
  Gene Symbol: DPF2
  Gene Name: D4, zinc and double PHD fingers family 2
  Uniprot ID: Q92785
  ENST ID: ENST00000415073
  CDS Start-End: 33-656
gcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaaggaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaa

SEQ ID NO: 124804 - DNA, 524 bp, Homo sapiens
  Payload ID: 4506
  Gene Symbol: DPF2
  Gene Name: D4, zinc and double PHD fingers family 2
  ENST ID: ENST00000532102
  CDS Start-End: 11-331
aacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttac

SEQ ID NO: 124805 - DNA, 1573 bp, Homo sapiens
  Payload ID: 4506
  Gene Symbol: DPF2
  Gene Name: D4, zinc and double PHD fingers family 2
  ENST ID: ENST00000531989
  CDS Start-End: 1-351
gcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcaggaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagag

SEQ ID NO: 124806 - DNA, 2799 bp, Homo sapiens
  Payload ID: 4506
  Gene Symbol: DPF2
  Gene Name: D4, zinc and double PHD fingers family 2
  Uniprot ID: Q92785
  ENST ID: ENST00000528416
  CDS Start-End: 134-1309
agtgctcgctctagtgcgcgcgcccggacggcgcctgcgcagagggcaaggaacctggtaccccggtgcggtcccggcgcctgcgcgctgcggactgtggggcttctcggcccgaggcagaggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttttttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaa

SEQ ID NO: 124807 - DNA, 3229 bp, Homo sapiens
  Payload ID: 4507
  Gene Symbol: DPF3
  Gene Name: D4, zinc and double PHD fingers, family 3
  Uniprot ID: Q92784
  ENST ID: ENST00000381216
  CDS Start-End: 14-1087
acattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagc

SEQ ID NO: 124808 - DNA, 3687 bp, Homo sapiens
  Payload ID: 4507
  Gene Symbol: DPF3
  Gene Name: D4, zinc and double PHD fingers, family 3
  ENST ID: ENST00000366353
  CDS Start-End: 307-1545
attctcgtcttcacccctggccactcctggagttgaaaaccaggttcgctcccggggacggtagggggttcctaacgcaaaggaatgcacagggagaatcggacgtgtttgcgccagctcgtcgcccatcagaaatagggaaaggggtaggaaggccccaggtttcaaatatatttatatgaaagctgccgttaagaggacgttggaagctgaggctgatcagataggagctcctggcttcagttctggctcggaagctcggatacactgcgcttgaacgccacagcgtttcacccaagaaagaaaatgttttatggcagaataaatgggcgtaacttcgccgcatcctcgctgccggttgctttcgctgcaacaccgctgatgctgtttctaccgaacccacaactgattttcagtttccccatttccagccgaaatcacataaccgggctgatgccacctggtaaactcaagttagagaacctatttcacatgtgcaccaggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagc

SEQ ID NO: 124809 - DNA, 4077 bp, Homo sapiens
  Payload ID: 4507
  Gene Symbol: DPF3
  Gene Name: D4, zinc and double PHD fingers, family 3
  Uniprot ID: Q92784
  ENST ID: ENST00000541685
  CDS Start-End: 29-1102
agacaatattctgttacattgtagcaaaatggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgctcctat

SEQ ID NO: 124810 - DNA, 1514 bp, Homo sapiens
  Payload ID: 4507
  Gene Symbol: DPF3
  Gene Name: D4, zinc and double PHD fingers, family 3
  Uniprot ID: Q92784
  ENST ID: ENST00000546183
  CDS Start-End: 128-1231
acattgtagcaaaatggcgactgtcattcacaaccccctgaaagcgccctttcaagaatcctatgaaagttgtggatcatctccccggaaaacacgcatatagatgtgaacatctgcctatggttttatggggttcacagacctggaagagcccatctctggatgccctggaggcccatgggctctagggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaata

SEQ ID NO: 124811 - DNA, 1138 bp, Homo sapiens
  Payload ID: 4507
  Gene Symbol: DPF3
  Gene Name: D4, zinc and double PHD fingers, family 3
  Uniprot ID: Q92784
  ENST ID: ENST00000556509
  CDS Start-End: 1-1137
atggcgactgtcattcacaaccccctgaaagcgctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctggtcacccaacctgcctgcagtttaccctgaacatgaccgaggctgtcaagacctacaagtggcagtgcatagagtgcaaatcctgtatcctctgtgggacctcagagaatgatgaccagctactcttctgcgatgactgtgaccgaggctatcacatgtactgtttaaatcccccggtggctgagcccccagaaggaagctggagctgccacttatgctgggaactgctcaaagagaaagcctcagcctttggctgccaggcctagg

SEQ ID NO: 124812 - DNA, 4520 bp, Homo sapiens
  Payload ID: 4507
  Gene Symbol: DPF3
  Gene Name: D4, zinc and double PHD fingers, family 3
  ENST ID: ENST00000610283
  CDS Start-End: 307-1545
attctcgtcttcacccctggccactcctggagttgaaaaccaggttcgctcccggggacggtagggggttcctaacgcaaaggaatgcacagggagaatcggacgtgtttgcgccagctcgtcgcccatcagaaatagggaaaggggtaggaaggccccaggtttcaaatatatttatatgaaagctgccgttaagaggacgttggaagctgaggctgatcagataggagctcctggcttcagttctggctcggaagctcggatacactgcgcttgaacgccacagcgtttcacccaagaaagaaaatgttttatggcagaataaatgggcgtaacttcgccgcatcctcgctgccggttgctttcgctgcaacaccgctgatgctgtttctaccgaacccacaactgattttcagtttccccatttccagccgaaatcacataaccgggctgatgccacctggtaaactcaagttagagaacctatttcacatgtgcaccaggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgctcctat

SEQ ID NO: 124813 - DNA, 4221 bp, Homo sapiens
  Payload ID: 4507
  Gene Symbol: DPF3
  Gene Name: D4, zinc and double PHD fingers, family 3
  Uniprot ID: Q92784
  ENST ID: ENST00000614862
  CDS Start-End: 143-1246
agacaatattctgttacattgtagcaaaatggcgactgtcattcacaaccccctgaaagcgccctttcaagaatcctatgaaagttgtggatcatctccccggaaaacacgcatatagatgtgaacatctgcctatggttttatggggttcacagacctggaagagcccatctctggatgccctggaggcccatgggctctagggctcggggaccagttctacaaggaagccattgagcactgccggagttacaactcacggctgtgtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaagaacaggactagaggacgggctcgcggctctgcagggggcaggaggaggcacgacgccgcctctcaggaagaccacgacaaaccttacgtctgtgacatctgtggcaagcgctacaagaaccgaccggggctcagctaccactatgctcacactcacctggccagcgaggagggggatgaagctcaagaccaggagactcggtccccacccaaccacagaaatgagaaccacaggccccagaaaggaccggatggaacagtcattcccaataactactgtgacttctgcttggggggctccaacatgaacaagaagagtgggcggcctgaagagctggtgtcctgcgcagactgtggacgctctgctcatttgggaggagaaggcaggaaggagaaggaggcagcggccgcagcacgtaccacggaggacttattcggttccacgtcagaaagtgacacgtcaactttccacggctttgatgaggacgatttggaagagcctcgctcctgtcgaggacgccgcagtggccggggttcgcccacagcagataaaaagggcagttgctaaacccacggaacagactctctgggcaattagccatccccctctgactttggtcattgtgctggttctgatatatattttttttaatgaaaggcaactttagattttccctctatccttgctttttttcccttcacctcccacgtgtccctccatccctccccccacccctctgttttgggtatgtacaacagaagcacaaactactgaaacaaaacaaaacagcagaatgagcgttcttccgagagatggcatcgtgatgcgctatttattttccatagaaataggaagttagacggattgtctcttttctgaggggagggggtctttttgacaggagcagagttgatgtcctcaattttcatatttattggcaaaaggaagagaagaggaactttgggttggaaacaaagaaccaataacattaaaacattattatttatatattctagctgttattagaatcagactttttttgcgagagagagagagagagagagagaagggaaatcaaagaaatcgaagcaatatcctgtttagaggcaagccgcccggtggggagaatttcctcaatgggagacggttgcactattctgtgccccacggagtttgcggctccccgcggcagacccctccctcattctcctccctgacctttccatcttcctctctgcttgcgagaaaatgtcagtagttccagagaagtcggggtgcctatgcctggcctccctccacacctgggccctgaccagccgcctcctgggctcctcctcctccgtcagtagagctgctgttttgttattgctggtttttcctcactttcctcctggcaaagaacgacttccaaatgcagggatggaatataagcagaacgtcatgggctcagcagtgactccaccacccgaggccgaggccgtgcttctggaagatagaaggagacatcatcgtgtgtttcccctccccttgcccctgttaagaaacgtatcaatacccattggatgatcaaggctaccgtatttcttctatttttttttatagtgcctgccaggcactttgttttatgtttccaatagcacttcctgaaataaaccaaagcaacactgctcaaggcccctggggcgatggagaaggccacccacctcactgacagtcccaagaatgaccggctgcgaggtcctagtcaaaagtcaacattatgacctggggactccagcatccttcaagcaagccatttccgaagaaggtgaaaagaagccaggatgattggcacctcctcctcctcctcctcttcttcctcttcccttgcccagccccctcctgtgcgtgtgtttcagacaacacaggagccagcacaggagtggaaaatcctgcagcgcaactcagctcagcccacagaagccttgggaatggcctcagtttgtgcaataagaagattttttttttctttttaaatcttcattatattttctttgattgtctgtgagaaagtacccaggtccgcctggaattactctacagtagaaataactgaacacaaacaaactgatggaaaaaaagagttaactattttatttatttcaatatttaaaaggaaaaaagtgctgacatggcacagtatttttgtttaaagtacctcctacttcaaaagttaagcgcaattttgtgaagacatgaaatcataagagtacttaatgtaaaataaaagactgcatattaactctaaagaaaaatgccccacattttaaataagaaaataaagatcaactctgctctctcaggctttttaaaaagccattcatgtatgtgctttaggtatttttatttctgcgagttggatgtggtaagtgaggagtgctcagtttttttttcctccttcaaaagtctattgaaagtgttggtgatgttaaatgattgtgtgttaagatttgactgaaataacttagccacaaatcagcagtttcccccaccctcattgccccctcaccccaggcaagccccttttatctgaatgtcagaagcagcctgcctcctagttatcatgtctgatgaggtctagctcaggaaggaattccatctattgatggaatatatcccctcaagttcaatagattcgaacacagagagctttgtttaaaataatgcagcaaaaaaaaaaaaaaaaaaaaagcaaaaataaaagcatcagctgaggtgatattagttcagtcacctaacaactcctagaagagatgaggaaagggaaccttctgctgagctggcttctggggcctgagcttccagagctgtccccaagggctaggaaggccgacctgaaggatgagaacctcaaattcagttgctggtgggagccaaggaagacggcgggtgttctaacatggccctttctggctgagctggcggaagtgggcgttttggccgatgggatgtatctcggcgctgtgtctgtggcccagcaaaggtgcagggctgactggctgagccactgggttctacccgcaggctccccactgcactgggctttcacacagccatgctcttgggtttccctcccttgtaagcagagtcataataacacacgaatagtctaaggctgggtattctggtcagcagaggtccttgagtcacagtgttactgaaatggttctgagcctgagaatctctttggcctctgaaagggcagggcaggtgggcaccgacttcctgccagtcctttcaggtttcctgttcaaagccagtcctgttggtggaggggatcaccgagagtgtctgtatcattttgtagcccttttctctgacgttttctggtagaaaatgtcccttgtcaaaatgctaataattatcataataatctgctttccaaccaactcccacaagtgacaacctgtgtagaactgtgataaaggtttgcataatgtagggtttgtaccaagtgtgtgtaagtttctgttaaataaaaagtctgtttccaatgctcctat

SEQ ID NO: 124814 - DNA, 4534 bp, Homo sapiens
  Payload ID: 4508
  Gene Symbol: DAB2
  Gene Name: Dab, mitogen-responsive phosphoprotein, homolog 2 (Drosophila)
  Uniprot ID: P98082
  ENST ID: ENST00000320816
  CDS Start-End: 469-2781
atttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacagaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaat

SEQ ID NO: 124815 - DNA, 3690 bp, Homo sapiens
  Payload ID: 4508
  Gene Symbol: DAB2
  Gene Name: Dab, mitogen-responsive phosphoprotein, homolog 2 (Drosophila)
  Uniprot ID: P98082
  ENST ID: ENST00000339788
  CDS Start-End: 279-1937
agtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcgggtgttgaccagatggatttgtttggggacatgtctacacctcctgacctaaatagtccaacatcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaat

SEQ ID NO: 124816 - DNA, 651 bp, Homo sapiens
  Payload ID: 4508
  Gene Symbol: DAB2
  Gene Name: Dab, mitogen-responsive phosphoprotein, homolog 2 (Drosophila)
  ENST ID: ENST00000515700
  CDS Start-End: 536-651
ctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccgtgcaacagaaataaaccaaatgtgtttgaacatatgtcagagggctgacataatcatatgaagaatgctataccagtttggctttgggacgaaatgtgaatctactagggcaacatacaactgccctctgagtcagaagatcagaagttgctgtggctacacataattctggggtacatgtggagaacatgcagttttgttacataggtatacatgtgccatggtggtttgctgcatccatcaacccatcacctacattaggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatct

SEQ ID NO: 124817 - DNA, 931 bp, Homo sapiens
  Payload ID: 4508
  Gene Symbol: DAB2
  Gene Name: Dab, mitogen-responsive phosphoprotein, homolog 2 (Drosophila)
  ENST ID: ENST00000507539
  CDS Start-End: 212-562
ctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaagaattcacatttgctgatacctctctgaccacctgagtctgaccaacaatttgctacttgaatttcggctccccttcttcgttctcaaagttctgtggggaacaaatatatcatatattacatctccagaagtaacaggcagaaaacagaataggaggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagca

SEQ ID NO: 124818 - DNA, 561 bp, Homo sapiens
  Payload ID: 4508
  Gene Symbol: DAB2
  Gene Name: Dab, mitogen-responsive phosphoprotein, homolog 2 (Drosophila)
  ENST ID: ENST00000503513
  CDS Start-End: 361-561
gctgtagcctggaggctccgggcgcggggaagtcatgctcgcttcacggaggcaatagctagccgtttttgtttggaaggaagagagccgctctgtaaaccgagaagagcagaaacaagcttccagacacatggaaagacttaaaaattatggaggggcgacttcacgaatagtaaatgttgctattgctctataaagtgacttcatgaaaaaatttctggccttagtcaggcaaagcaggggcatgggggagaaggaggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaa

SEQ ID NO: 124819 - DNA, 2740 bp, Homo sapiens
  Payload ID: 4508
  Gene Symbol: DAB2
  Gene Name: Dab, mitogen-responsive phosphoprotein, homolog 2 (Drosophila)
  Uniprot ID: P98082
  ENST ID: ENST00000509337
  CDS Start-End: 81-2330
tatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcggaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttg

SEQ ID NO: 124820 - DNA, 551 bp, Homo sapiens
  Payload ID: 4508
  Gene Symbol: DAB2
  Gene Name: Dab, mitogen-responsive phosphoprotein, homolog 2 (Drosophila)
  ENST ID: ENST00000511792
  CDS Start-End: 325-551
gcacacatgaaacatggcaatgttcagggcagcatgtgattgactgccaaagtgtctcgagcaggaagtaccaagggaggatggagatggtaataatcagggttgggtggagaatatctgaggaaactgcacttgatttgggccttgaagagtaattgactggatttagatttatctagaaaggtcgttcccagcagaagcaacaagaacaacaagcttggaggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaact

SEQ ID NO: 124821 - DNA, 4537 bp, Homo sapiens
  Payload ID: 4508
  Gene Symbol: DAB2
  Gene Name: Dab, mitogen-responsive phosphoprotein, homolog 2 (Drosophila)
  Uniprot ID: P98082
  ENST ID: ENST00000545653
  CDS Start-End: 532-2781
gtccttatttgcacccgccccccgcccgcgtcggtctggggcttttgacttctccccgaacacatttcccctcccgtcgctgggtccctgcgatcgcccccagctggtggggctcgcggagctcaggggagcggggtcctctgcgccgctgcagcgcgagttaataaacagttaagtttggaagactctgcagacacgttgagggggagttaccaagcccaggcagcaaaaacatcctggcacattcctggggagtcctcagctgccagcatctgattagaaccatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaagggaatggcggcagctggtcggtctcagggacaacacaaacaaaggatctgggtcaacatttccctttctgggataaaaataattgatgagaaaactggggtaatagagcatgaacatccagtaaataagatttctttcattgcccgtgatgtgacagacaaccgggcatttggttacgtgtgtggaggagaaggccagcatcagttttttgccataaaaaccgggcaacaggctgaaccattagttgttgatcttaaagacctttttcaagttatctataatgtaaagaaaaaggaagaagaaaagaaaaagatagaggaagccagcaaagcagttgagaatgggagtgaggccctaatgattctagatgaccaaactaacaaactgaaatcggaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatgaaccaccaaagccagctcccagacaagtttccctgccagttaccaaatctactgacaatgcatttgagaaccctttctttaaagattcttttggttcatcacaagcctctgtggcttcttctcaacctgtatcttctgagatgtatagggatccatttggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaatatc

SEQ ID NO: 124822 - DNA, 647 bp, Homo sapiens
  Payload ID: 4509
  Gene Symbol: DAB1
  Gene Name: Dab, reelin signal transducer, homolog 1 (Drosophila)
  ENST ID: ENST00000332102
  CDS Start-End: 36-647
gggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccaggttcccaccagccaaaagaaggaaggtgtttatgatgtgccaaaaagtcaacct

SEQ ID NO: 124823 - DNA, 1150 bp, Homo sapiens
  Payload ID: 4509
  Gene Symbol: DAB1
  Gene Name: Dab, reelin signal transducer, homolog 1 (Drosophila)
  Uniprot ID: O75553
  ENST ID: ENST00000371230
  CDS Start-End: 265-906
cccagctcggcgctcgcccgggcttccccgggctgcagagcgcgcctgagtgccgccgcccgccgggcatggggagccgcttcctgggcggctgcggcagcggaggaggatgctctgggctaggcgagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccaggtaatttctgaaactagtcggggttttagattcaagagtgactagacctgtgccagagccattttgtcagaaacctgaagaatccactgactgcaaaacctggagagagaccaagattatttctgagggtgagggctgccagcccctccaggagcaaatttccataaaaactaacagaagtttggccggcatcggtatcttgggatttggagatccgcttctcccttcttgcctctgcctcggcccccttcacagtctgtaaaagtttgatcccagagctgaatgtttt

SEQ ID NO: 124824 - DNA, 1802 bp, Homo sapiens
  Payload ID: 4509
  Gene Symbol: DAB1
  Gene Name: Dab, reelin signal transducer, homolog 1 (Drosophila)
  Uniprot ID: O75553
  ENST ID: ENST00000371231
  CDS Start-End: 36-1802
gggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctag

SEQ ID NO: 124825 - DNA, 752 bp, Homo sapiens
  Payload ID: 4509
  Gene Symbol: DAB1
  Gene Name: Dab, reelin signal transducer, homolog 1 (Drosophila)
  ENST ID: ENST00000371232
  CDS Start-End: 36-752
gggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcc

SEQ ID NO: 124826 - DNA, 5298 bp, Homo sapiens
  Payload ID: 4509
  Gene Symbol: DAB1
  Gene Name: Dab, reelin signal transducer, homolog 1 (Drosophila)
  Uniprot ID: O75553
  ENST ID: ENST00000371236
  CDS Start-End: 265-1932
cccagctcggcgctcgcccgggcttccccgggctgcagagcgcgcctgagtgccgccgcccgccgggcatggggagccgcttcctgggcggctgcggcagcggaggaggatgctctgggctaggcgagcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacacaaaaaaagtatagaaagatccacccaacattaaatcagaaatcaagcaaatgcttacccaacaaatatttgagccctcatagctgggtttaagatgactcagtgtgcaaaattattaattccctttttatttctctacctgttgaccactgttgagacaccaaatttggagtgacaggcatcagaggattacaacagggttggaactgacttctttaagcaaaagcaaagggtcttctgtgaccacaatatcgtcatccatatgccttttcacataggatgatgtgttttttgtcactccatggggcctggtctgccattttcccccctttcctttttttgtcatgtttgaaaattaataggtgtacaaatttttgtattgcttttgactttttttagatatgggtgaagaaatctaactggggagaaaaaaagcctcagtgaaatgaattaacttgaaattacaagacaaataagtggttgattattcattatgatcacgaatgttgccaaaacagtcctttagctattctgcatcctggtgaagaaagacagctttcagtacgaaccttcattctgtgagtaggaaaagacatcagatcccattgatgagaaagatgaaaaatgcatctgatttcttaagaagctctaaactctaagtacaataaaatgatattttttatttttccgatatcttgctgctgtgttgctatgcagacaagtgtcttctccacgtgccattttcaaagaaaagtcatttgccaaataattctggtacaattctggtaatgtggttttggatcttaaaaaccaactttctaatggaacaatggtggcataaatattcagaataacaaactgattctgtggtccaaatggttcatctctatctctttttgtacatcagaaaattcaaatgggatttttattttataacttgaaaaaaaaaccttaccattaaactctttaaatatttaagggaaatggctttaaggagttctaatgaaaaaaaattgtcttttttttgtaaatataaatgttaatgaaaatgatttttaataatgccattacactgtagagaaggtagcagattgagtgcaaggtgtgacaaacttgatggatggggctcactttccagacgttattctggagcatatggtaggaagctggagtgcagggacagctggcaggagcagttggccaatcagcagctagtgaacgggaagggagcacgtgactccatcatctagcctttccacgagagtccccaccctacgtgcaacacaagaaaaagacaattcacattctgaagaattcagattctgaaactctcccacctccccactcccacctacccccgatataaatcactggactgtttgtacgtgaaacagaagaggctaagcttcctttttttacacttatgagacaaaaagtgcagtgtttggttcgtatgtttagcacatgattttcataaagaatctatatatttttgccctacagagaattgttatacaggtcaagtgtgttttcctgatgttcctatgcagttacagtatgttgaaagtgttttaacactaagaagaaaactttaaagattcatgtgattaattggatttgaggataattattattatttggtttttagatttgaaaagtagaatttccattgagacaattgatttgaataggcctgcatttgattcttcatatcaatagaaactaaaatgatttgggagattcatttgaaaaatgattgtatacttgttcacaaagcgaaaagtgatacatgaaggtaatggttatcatttaaagcccacattttacactatcaggtcacaggagtctaatttttttttcagttagataaactgaccaaacgtctattcaagaatatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccaggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagaacaaca

SEQ ID NO: 124827 - DNA, 5168 bp, Homo sapiens
  Payload ID: 4509
  Gene Symbol: DAB1
  Gene Name: Dab, reelin signal transducer, homolog 1 (Drosophila)
  Uniprot ID: O75553
  ENST ID: ENST00000414851
  CDS Start-End: 139-1806
agcactcaaaaagagtgaatgaaatgtgcagctcagagtgtcatttctgaagggaggagtctttctcttggagaagagtcctcaatgagcctggccgaggcccgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccagacaatattggaagaggatgttgaagatcctgtgtaccagtacattgtgtttgaggctggacacgagccaatccgtgatcccgaaacggaagaaaacatttatcaggttcccaccagccaaaagaaggaaggtgtttatgatgtgccaaaaagtcaacctgtaagtgctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacaggctctcttgtattctttcacctcttcccacaagaaattcatgattgcccaatggaactcgctcagaagagggaactaagcatttttggcaaccaatggcagatatctatggcagcacacaaaaaaagtatagaaagatccacccaacattaaatcagaaatcaagcaaatgcttacccaacaaatatttgagccctcatagctgggtttaagatgactcagtgtgcaaaattattaattccctttttatttctctacctgttgaccactgttgagacaccaaatttggagtgacaggcatcagaggattacaacagggttggaactgacttctttaagcaaaagcaaagggtcttctgtgaccacaatatcgtcatccatatgccttttcacataggatgatgtgttttttgtcactccatggggcctggtctgccattttcccccctttcctttttttgtcatgtttgaaaattaataggtgtacaaatttttgtattgcttttgactttttttagatatgggtgaagaaatctaactggggagaaaaaaagcctcagtgaaatgaattaacttgaaattacaagacaaataagtggttgattattcattatgatcacgaatgttgccaaaacagtcctttagctattctgcatcctggtgaagaaagacagctttcagtacgaaccttcattctgtgagtaggaaaagacatcagatcccattgatgagaaagatgaaaaatgcatctgatttcttaagaagctctaaactctaagtacaataaaatgatattttttatttttccgatatcttgctgctgtgttgctatgcagacaagtgtcttctccacgtgccattttcaaagaaaagtcatttgccaaataattctggtacaattctggtaatgtggttttggatcttaaaaaccaactttctaatggaacaatggtggcataaatattcagaataacaaactgattctgtggtccaaatggttcatctctatctctttttgtacatcagaaaattcaaatgggatttttattttataacttgaaaaaaaaaccttaccattaaactctttaaatatttaagggaaatggctttaaggagttctaatgaaaaaaaattgtcttttttttgtaaatataaatgttaatgaaaatgatttttaataatgccattacactgtagagaaggtagcagattgagtgcaaggtgtgacaaacttgatggatggggctcactttccagacgttattctggagcatatggtaggaagctggagtgcagggacagctggcaggagcagttggccaatcagcagctagtgaacgggaagggagcacgtgactccatcatctagcctttccacgagagtccccaccctacgtgcaacacaagaaaaagacaattcacattctgaagaattcagattctgaaactctcccacctccccactcccacctacccccgatataaatcactggactgtttgtacgtgaaacagaagaggctaagcttcctttttttacacttatgagacaaaaagtgcagtgtttggttcgtatgtttagcacatgattttcataaagaatctatatatttttgccctacagagaattgttatacaggtcaagtgtgttttcctgatgttcctatgcagttacagtatgttgaaagtgttttaacactaagaagaaaactttaaagattcatgtgattaattggatttgaggataattattattatttggtttttagatttgaaaagtagaatttccattgagacaattgatttgaataggcctgcatttgattcttcatatcaatagaaactaaaatgatttgggagattcatttgaaaaatgattgtatacttgttcacaaagcgaaaagtgatacatgaaggtaatggttatcatttaaagcccacattttacactatcaggtcacaggagtctaatttttttttcagttagataaactgaccaaacgtctattcaagaatatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccaggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagaac

SEQ ID NO: 124828 - DNA, 1817 bp, Homo sapiens
  Payload ID: 4509
  Gene Symbol: DAB1
  Gene Name: Dab, reelin signal transducer, homolog 1 (Drosophila)
  Uniprot ID: O75553
  ENST ID: ENST00000420954
  CDS Start-End: 37-1698
cgggatctgtgtgaagtggactaaggattaagtaggatgtcaactgagacagaacttcaagtagctgtgaaaaccagcgccaagaaagactccagaaagaaaggtcaggatcgcagtgaagccactttgataaagaggtttaaaggtgaaggggtccggtacaaagccaaattgatcgggattgatgaagtttccgcagctcggggagacaagttatgtcaagattccatgatgaaactcaagggcgttgttgctggcgctcgttccaaaggagaacacaaacagaaaatctttttaaccatctcctttggaggaatcaaaatctttgatgagaagacaggggcccttcagcatcatcatgctgttcatgaaatatcctacattgcaaaggacattacagatcaccgggcctttggatatgtttgtgggaaggaagggaatcacagatttgtggccataaaaacagcccaggcggctgaacctgttattctggacttgagagatctctttcaactcatttatgaattgaagcaaagagaagaattagaaaaaaaggcacaaaaggataagcagtgtgaacaagctgtgtaccaggttcccaccagccaaaagaaggaaggtgtttatgatgtgccaaaaagtcaacctgtaagtaatggctattcgtttgaggattttgaagaacggtttgctgcagccaccccgaacagaaacctgcccacagactttgatgagatttttgaggcaacgaaggctgtgacccaattagaactttttggggacatgtccacaccccctgatataacctctccccccactcctgcaactccaggtgatgcctttatcccatcttcatctcagacccttccagcgagtgcagatgtgtttagttctgtacctttcggcactgctgctgtaccctcaggttacgttgcaatgggcgctgtcctcccgtccttctggggtcagcagcccctcgtccaacagcagatggtcatgggtgcccagccaccagtcgctcaggtgatgccgggggctcagcccatcgcatggggccagccgggtctctttcctgccactcagcagccctggccaactgtggccgggcagtttccgccagccgccttcatgcccacacaaactgttatgcctttgccagctgccatgttccaaggtcccctcaccccccttgccaccgtcccaggcacgagtgactccaccaggtcaagtccacagaccgacaagcccaggcagaaaatgggcaaagaaacgtttaaggatttccagatggcccagcctccgcccgtgccctcccgcaaacccgaccagccctccctcacctgtacctcagaggccttctccagttacttcaacaaagtcggggtggcacaggatacagacgactgtgatgactttgacatctcccagttgaatttgacccctgtgacttctaccacaccatcgaccaactcacctccaaccccagcccctagacagagctctccatccaaatcatctgcatcccatgccagtgatcctaccacagatgacatctttgaagagggctttgaaagtcccagcaaaagcgaagagcaagaagctcctgatggatcacaggcctcatccaacagtgatccatttggtgagcccagtggggagcccagtggtgataatataagtccacaggccggtagctagatagcgcaggtctgggagccagagcctctgtacgcgcagatcaacagacctaagaaatagcatcgatgcgagctcgtggtgggtgctcaagactggcatggacatcagcatcacgacag

SEQ ID NO: 124829 - DNA, 5469 bp, Homo sapiens
  Payload ID: 4510
  Gene Symbol: DAB2IP
  Gene Name: DAB2 interacting protein
  Uniprot ID: Q5VWQ8
  ENST ID: ENST00000259371
  CDS Start-End: 88-3486
ggaatacaaaaggaggaacccagacgctcatggagacagcctcggttcataaatcaggtggggccaggggctgggggcccacacgccatggagcccgactcccttctggaccaagacgactcctacgagtcgcctcaagaaaggccgggctctcggcgcagcctgcctggcagcctttccgagaagagccccagcatggagccctcggccgccacgccgttccgggtcacgggcttcctcagccgccgcctcaagggctccatcaagcgcaccaagagccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctatttt

SEQ ID NO: 124830 - DNA, 3500 bp, Homo sapiens
  Payload ID: 4510
  Gene Symbol: DAB2IP
  Gene Name: DAB2 interacting protein
  Uniprot ID: Q5VWQ8
  ENST ID: ENST00000309989
  CDS Start-End: 148-3345
tgttcctcttctttcgtgttgtgtcagaagccatgatttccagtcttctcatctggaagatgaaggaaaagatagacccgaccccacagggttctgaggctcaaactgaaagcctggtggtggggcacctgtgacaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgca

SEQ ID NO: 124831 - DNA, 5193 bp, Homo sapiens
  Payload ID: 4510
  Gene Symbol: DAB2IP
  Gene Name: DAB2 interacting protein
  ENST ID: ENST00000373782
  CDS Start-End: 1-3210
agccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctatttt

SEQ ID NO: 124832 - DNA, 1006 bp, Homo sapiens
  Payload ID: 4510
  Gene Symbol: DAB2IP
  Gene Name: DAB2 interacting protein
  ENST ID: ENST00000394340
  CDS Start-End: 133-1006
tgcttgcaggaatacccagtcatctagttggaaaagccgccagatggaatacaaaaggaggaacccagacgctcatggagacagcctcggttcataaatcaggtggggccaggggctgggggcccacacgccatggagcccgactcccttctggaccaagacgactcctacgagtcgcctcaagaaaggccgggctctcggcgcagcctgcctggcagcctttccgagaagagccccagcatggagccctcggccgccacgccgttccgggtcacgggcttcctcagccgccgcctcaagggctccatcaagcgcaccaagagccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagg

SEQ ID NO: 124833 - DNA, 6784 bp, Homo sapiens
  Payload ID: 4510
  Gene Symbol: DAB2IP
  Gene Name: DAB2 interacting protein
  Uniprot ID: Q5VWQ8
  ENST ID: ENST00000408936
  CDS Start-End: 183-3752
gggagcgggagggggcaggaggcggaggaggagtttgagcgactttgtggggcagccagggcctcggcggccgctcgggcgagcgcgggagaacgcgtgggcgcccgccgggctgtccggagcggccgatggggcccgtgtgagcgcgcccaggcccggcccggtgcccggcgggcggcagcatgtccgcgggcggcagcgccaggaagagcaccgggaggtcctcctactactaccggctgctgaggcggccccggctgcagcgacagaggagccgctcccgcagccggacccggcctgccagggagtcgcctcaagaaaggccgggctctcggcgcagcctgcctggcagcctttccgagaagagccccagcatggagccctcggccgccacgccgttccgggtcacgggcttcctcagccgccgcctcaagggctccatcaagcgcaccaagagccagcccaagctggaccgcaaccacagcttccgccacatcctgccggggttccggagcgccgccgccgccgccgcggacaatgagaggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcaccaaccactacctggggctgtgtgcagccctcgagcccatcctcagtgccaagaccaaggaggagatggcatctgccctggtgcacatcctgcagagcacgggcaaggtgaaggacttcctgacagacctgatgatgtcagaggtggaccgctgcggggacaacgagcacctcatcttccgggagaacacactggccaccaaggccattgaggagtacctcaagctagtgggccagaagtacctgcaggacgccctaggtgagttcatcaaagcgctgtatgagtcagatgagaactgcgaagtggatcccagcaagtgctcggccgctgacctcccagagcaccagggcaacctcaagatgtgctgcgagctggccttctgcaagatcatcaactcctactgtgtcttcccacgggagttgaaagaggtgtttgcctcgtggaggcaggagtgcagcagtcgcggccgcccggacatcagtgagcggctcatcagcgcctccctcttcctgcgcttcctctgcccagccatcatgtcgccctcactcttcaacctgctgcaggagtaccctgatgaccgcactgcccgcaccctcaccctcatcgccaaggtcacccagaacctggccaactttgccaaatttggcagcaaggaggaatacatgtccttcatgaaccagttcctagagcatgagtggaccaacatgcagcgcttcctgctggagatctccaaccccgagaccctctccaatacagccggcttcgagggctacatcgacctgggccgcgagctctccagcctgcactcactgctctgggaggccgtcagccagctggagcagagcatagtatccaaactgggacccctgcctcggatcctgagggacgtccacacagcactgagcaccccaggtagcgggcagctcccagggaccaatgacctggcctccacaccgggctctggcagcagcagcatctcagctgggctgcagaagatggtgattgagaacgatctttccggtctgatagatttcacccggttaccgtctccaacccccgaaaacaaggacttgttttttgtcacaaggtcctccggggtccagccctcacctgcccgcagctcgagttactcggaagccaacgagcctgatcttcagatggccaacggtggcaagagcctctccatggtggacctccaggacgcccgcacgctggatggggaggcaggctccccggcgggccccgacgtcctccccacagatgggcaggccgctgcagctcagctggtggccgggtggccggcccgggcaaccccagtgaacctggcagggctggccacggtgcggcgggcaggccagacaccaaccacaccaggcacctccgagggcgcgccaggccggccccagctgttggcaccgctctccttccagaaccctgtgtaccagatggcggctggcctgccgctgtcaccccgtggccttggcgactcaggctctgagggccacagctccctgagctcacacagcaacagcgaggagttggcggctgctgccaagctgggaagtttcagcactgccgcggaggagctggctcggcggcccggtgagctggcacggcgacagatgtcactgactgaaaaaggcgggcagcccacggtgccacggcagaacagtgctggcccccagaggaggatcgaccagcctccgcccccacccccgccgccacctcctgccccccgcggccggacgccccccaacctgctgagcaccctgcagtacccaagaccctcaagcggaaccctggcgtcggcctcacctgattgggtgggccccagtacccgcctgaggcagcagtcctcttcctccaagggggacagcccagaactgaagccacgggcagtgcacaagcagggcccttcacctgtgagccccaatgccctggaccgcacagccgcttggctcttgaccatgaacgcgcagttgttagaagacgagggcctgggcccagaccccccccacagggataggctaaggagtaaggacgagctcagccaagcagaaaaggacctggcggtgctgcaggacaagctgcgaatctccaccaagaagctggaggagtatgagaccctgttcaagtgccaggaggagacgacgcagaagctggtgctggagtaccaggcacggctggaggagggcgaggagcggctgcggcggcagcaggaggacaaggacatccagatgaagggcatcatcagcaggttgatgtccgtggaggaagaactgaagaaggaccacgcagagatgcaagcggctgtggactccaaacagaagatcattgatgcccaggagaagcgcattgcctcgttggatgccgccaatgcccgcctcatgagtgccctgacccagctgaaagagaggtacagcatgcaagcccgtaacggcatctcccccaccaaccccaccaaattgcagattactgagaacggcgagttcagaaacagcagcaattgttaacctgcctgaggagggaggaagctacccaaggagagggggactatggtggccaagggcagggtctcggcctggggaggcacccacggttgcagccccagcgcgggtgtcaggaggccgagcctcccctccctgccgctgtccaggaggcggccgcagagggagccaccagagactgaagcagcgtgaggcgaggtcaccagccgctccctgtggggtgcgggcagaagagactgcacgctggggagtggggacagcctgatggggcagggggcctgccaaaaatatgtctgttggttcctgaatgtggtgtgtccttgtcctcctggatctggccgagtgcatgtgtccccccacacctgtgccagggagggggcttcctggaggggggattcaagggctaggggcctacacctgtggcttcccctcgcctccttggggggcccgggactccctggcagccaggccctgtcatgtgggacctggcacttggcagatcagttggcaggcaggaagataggaggacacagagcaggaggtcagtgtcccctgcctgtctccatccgaagcacctgccactgcatgcagcctgttgggaccttcctggctgtgaggaactgaggattcctacccacccaccccctctgaacctgtccccagagcaccacctgctaccttcttccctgccttagttgtattgccagatagacccagtgagggccatggctttttcttgtgagctcttgtccctgtggggaggacccacagcttcccacacctcccacacaggcccaggctgatgctctagggctcccagaagccagagatctgggcggatctggccagatggctctgagcactgtatctgccttctcctggggcccagcacacccagggcacagtggtcctgtagggagtgccacctggtgctcaccctgaaagaaaaggtgatccttcctctgagtgatggtttaaaaaaagattctaacgcctgcaggccctgagaaggtggataactgtgattttttttcctttcacagtatgcattagaaacaaaagcccgcttgctcgcttgctggaacacaggggccttttaagttgagcgtgcgcactgcatgggaaatagcggccctggaggatgttagacttgctccctctccaagacagcagcagcctgcacctgccccgtgtgtgtggccggcctcctcctcacccttcccggcccccggccaaggacccaggcgctgcatacaggggaggggcgcaccccacagctggggccggttttcctcagctctaggctgttctgtagcttatctgcccctcccccactttcaagacagatgagcaggagcttgggtctctctcggcccctgtctgttcccagcccctgcagattctgagcaaaggccctgggtaagaagggtgggagtggggcctttgccagcagagccagggcagggcgagctgcaggaatcacccctctgcccctgcagctggaatgtgccacagaggccccacctgaagggtggatgtgctggaggggtggcccagagccatactgcgtccaccctgagctcggggacaggtgacagtggctgctctgggaaggggcttttagatgtaacctacaattcagttaggctagagacagatgctggtggaggaagggctgggccaccagggatcacagaccacaggaagatgggaggtggaagcagaggccctgcccccaccccttcctgtctcactcttctgtcttgtccccacccatgcgccttcgtgcctgagaccagggtggccacacaggcagggcctggctccagtctcatcctcccattgcccagtgagccctgctcttctctccccagccccctcccaccgctgcctcgtagagtgacctcggacagagcccccctagcaatacagggaggctcccggggcctggacaggcgggctcggaggctacccgctgtggccggtgccagctgcccttgcagggtgggtgagctctcaggccgagagccttatttacctagtgcaaaaactgtaaaagtgtacagactcttcacagatttttatcttaattgcaagtctgccgattttgtaaatgttcttggtgtttgactgtaatgtaactatctcacctaatggttgtacatatcctttggtcctggtgctgccgagggctggccgggactgctgctctcccaagggttttattttatttctgaatctagagaacagtattgggcaggaggaaaaggcttggtgtctgcggggggtgtcttccctgcctgtggcatttgtgtgttggctttgcagctgctgtctgagtagtggccactggggtgccttcactgggccagtcaacggggggctcctgcccaggccacagagaacctgagttcccgggagctgggccctgcctgcagccagggctggggttgccagaggccctggagggaaggacagtccctgctggggaagaacagccccggggccccctggtcaccgagactcagcctctgctggagaaagccacgccctccctgctagcacagaggcctgactgacttttttgcttaacttccatgttctgggtgatggaaactgccaaacctcctgtcagtgaggactctttccgactgcccagaaagtgggggtggaggaccgaggctacagctccacacgccccggtcccccagagcatctgccccaggtacacctccccctgcgccccgcacgactgcgggagccagactgtccagggaaacagcctctctcttttctacacactcagccacaaagccccccagctcccacaccgcgtcccagctcccctcttttgtaagtatgtgaaaaggaaaaaatgcaaacgttggagtttgggctggagctcctccctccagctgcgacttttaactatgtaataatgtacagaggaagctgttggtgttctaagactctgtgtggctgtgcaatttctgtacatttgcaattagaaatattaaagatttatttagctattttaa

SEQ ID NO: 124834 - DNA, 928 bp, Homo sapiens
  Payload ID: 4510
  Gene Symbol: DAB2IP
  Gene Name: DAB2 interacting protein
  ENST ID: ENST00000436835
  CDS Start-End: 242-928
ggaatacaaaaggaggaacccagacgctcatggagacagcctcggttcataaatcaggtggggccaggggctgggggcccacacgccatggagcccgactcccttctggaccaagacgactcctacgagtcgcctcaagaaaggccgggctctcggcgcagcctgcctggcagcctttccgagaagagccccagcatggagccctcggccgccacgccgttccgggtcacggtcccatctgatgccgaggctgaaggagtctcgctcccacgagtccctgctcagccccagcagtgcggtggaggcgctggacctcagcatggaggaagaggtggtcatcaagcccgtgcacagcagcatccttggccaggactactgcttcgaggtgacgacgtcatcaggaagcaagtgcttttcctgccggtctgcagctgagcgggataagtggatggagaacctccggcgagcggtgcatcccaacaaggacaacagccggcgtgtggagcacatcctgaagctgtgggtgatcgaggccaaggacctgccagccaagaagaagtacctgtgcgagctgtgcctggacgatgtgctctatgcccgcaccacgggcaagctcaagacggacaatgttttctggggcgagcacttcgagttccacaacttgccgcctctgcgcacggtcactgtccacctgtaccgggagaccgacaagaagaagaagaaggagcgcaacagttacctgggcctggtgagcctacctgctgcctcggtggccgggcggcagttcgtggagaagtggtacccggtggtgacgcccaaccccaagggcggcaagggccctggacccatgatccgcatcaaggcgcgctaccaaaccatcaccatcctgcccatggagatgtacaaagagttcgctgagcacatcacc

SEQ ID NO: 124835 - DNA, 4627 bp, Homo sapiens
  Payload ID: 4511
  Gene Symbol: DACH1
  Gene Name: dachshund family transcription factor 1
  ENST ID: ENST00000620444
  CDS Start-End: 424-1938
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaatatataagtgtaacatgttttcattccaaactggtagtggtatgtagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctagctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgtttgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 124836 - DNA, 5233 bp, Homo sapiens
  Payload ID: 4511
  Gene Symbol: DACH1
  Gene Name: dachshund family transcription factor 1
  Uniprot ID: Q9UI36
  ENST ID: ENST00000613252
  CDS Start-End: 424-2544
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaatatataagtgtaacatgttttcattccaaactggtagtggtatgtagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctagctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgtttgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 124837 - DNA, 4789 bp, Homo sapiens
  Payload ID: 4511
  Gene Symbol: DACH1
  Gene Name: dachshund family transcription factor 1
  ENST ID: ENST00000611519
  CDS Start-End: 424-2100
atctttgatcaatgtacttgccagggagagcccaagtccttcaaacctcctccttttcaccttcatccttaactttgtgctagagcgagacccacacaacaacagccgaccctccccgccccacccccacccccaaaccagccctcgatcccagcccccggagaggactcgcatttcgacttgcgggacacttttgtgcgttcctctccagagcgcctctcgtgctcgcccctcttgcgctcgctctttattaccttcacctccttttctcccccttctctccctttctccttctcgttctctcccggagttgttgttgcccccctcgctccttctccccccttttttccccttcccctcccgggggtgtgtggcaacttttcctctcgcttctcctccgtctgtttccccttatatgtgaccatggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcgatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaatatataagtgtaacatgttttcattccaaactggtagtggtatgtagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctggagtcacagtattaatgaatgagatcttaagcatctggtgacatcagaactctgtgtcagccacttttatttgtatattgaaccctagctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtagcgctgagtgataaagttaaaatgtgctgtgcttcccacccttgtcagagggaagggtggctatgtgttattttcactgtctttttgaaagttacagtatgtgttttcactttcgtgcagataactggaagtaaagcggcaaacagtgcttattacatgctaaagttaccttctctttgttttttgcatatctggaattacacctttaaagactgatatgaatcagtacggtcactatacattttatgatttttctgtcatcttaaaattgtatgatcgtaacattatttattaccacaaaacagcaaaatcttcaatgtctaagaaaactagcttaaaatgtttaaatatagttctgattgggtattaattacttgattaagaaaaaattaacattatagatactctggcattacgcttctataccttttaggtcttccttgcaatactggaacataattcttttgtgtagctcactattagccagctaagttcatctttttaataccataaaaaggttatatgtacagttcctattttagcttgcttacaaagggagcattatttttatttaaagtattgctagtaaatgatttgtagaaacttggttttctaagcatagttcttccataaccaccttttgttgtttgagcacaagggattcttttcctagttctatgtgtttgtttccctatatgcagtctttaaaggattacaacacttaaaattgaatggacttgtgtcaagctttttgcatcatacattttttgaaagatttttaaaaaagcctacaacttacatatgtagtagaatcagccattgctctgctcctggcatagagtcacctgtttgttatgtggattaaatagttttaaaatacatatttgaagacctttgagaatgctttagtgtttgatttgaaataaaaggaaattttagcaaggattaaagaaaaaagctatcagctgtatgttaagagagactcttactaacatgttgtaaatattacaattcatgaaatgttattgtaagtctgtaacttaattttttccctgttttagttatacaggttggtttggaaatttgtgttttggcataaacaagtaaaatgtgcccattttatggtttccatgcttttgtaatcctaaaaatattaatgtctagttgttctatattataaccacatttgcgctctatgcaagcccttggaacagaacatactcatcttcatgtaggacctatgaaaattgtctatttttatctatatatttaaagttttctaaaaatgataaaaggttattacgaattttgttgtacaaaatctgtacaaaaatctgtttttacatcataatgcaagaattggaaatttttctatggtagcctagttatttgagcctggtttcaatgtgagaaccacgtttactgttattgtatttaattttcttttccttttcaacaatctcctaataaaactgtctgaaatctc

SEQ ID NO: 124838 - DNA, 2986 bp, Homo sapiens
  Payload ID: 4511
  Gene Symbol: DACH1
  Gene Name: dachshund family transcription factor 1
  ENST ID: ENST00000619232
  CDS Start-End: 1-2277
atggcagtgccggcggctttgatccctccgacccagctggtcccccctcaacccccaatctccacgtctgcttcctcctctggcaccaccacctccacctcttcggcgacttcgtctccggctccttccatcggacccccggcgtcctctgggccaactctgttccgcccggagcccatcgcttcggcggcggcggcggcggccacagtcacctctaccggcggcggcggcggcggcggcggcagcggaggcggcggcggcagcagcggcaacggaggcggcggtggcggcggcggcggtggcagcaactgcaaccccaacctggcggccgcgagcaacggcagcggcggcggcggcggcggcatcagcgctggcggcggcgtcgcttccagcacccccatcaacgccagcaccggcagcagcagcagcagcagtagcagcagcagcagcagcagcagtagtagcagcagcagcagtagcagcagcagctgcggccccctccccgggaaacccgtgtactcaaccccgtccccagtggaaaacacccctcagaataatgagtgcaaaatggtggatctgaggggggccaaagtggcttccttcacggtggagggctgcgagctgatctgcctgccccaggctttcgacctgttcctgaagcacttggtggggggcttgcatacggtctacaccaagctgaagcggctggagatcacgccggtggtgtgcaatgtggaacaagttcgcatcctgaggggactgggcgccatccagccaggagtgaaccgctgcaaactcatctccaggaaggacttcgagaccctctacaatgactgcaccaacgcaagttctagacctggaaggcctcctaagaggactcaaagtgtcacctccccagagaactctcacatcatgccgcattctgtccctggtctcatgtctcctgggataattccaccaacaggtctgacagcagccgctgcagcagctgctgctgctaccaatgcagctattgctgaagcaatgaaggtgaaaaaaatcaaattagaagccatgagcaactatcatgccagtaataaccaacatggagcagactctgaaaacggggacatgaattcaagtgtcggcagcagtgatggttcctgggataaggaaacactgccctcttccccatcccagggacctcaggcctctataacccacccccgcatgcctggagcacgtagccttccacttagtcatcctctcaaccatcttcagcagagccaccttctgccaaatggactggaacttccttttatgatgatgccccaccctctaattcctgtcagcctacctccagcatctgtcaccatggcaatgagccagatgaaccacctcagcaccattgcaaatatggcagcagcagcacaagttcagagtcccccatccagagttgagacatcagttattaaggagcgtgttcctgatagcccctcacctgccccctctctggaggaggggagaaggcctggcagtcacccatcatcacatcgcagcagcagcgtgtccagctcccctgctcggactgagagctcttctgacagaatcccggtccatcagaatgggttgtccatgaaccagatgctgatgggcttatcaccaaatgtacttcctgggcccaaagagggagatttggccggtcatgacatgggacatgagtcaaaaaggatgcatattgaaaaagatgagaccccgctttctacaccaaccgcaagagacagccttgacaaactctctctaactgggcatggacaaccactgcctccaggttttccatctccttttctgtttcctgatggactgtcttccatcgagactcttctgactaacatacaggggctgttgaaagttgccatagataatgccagagctcaagagaaacaggtccaactggaaaaaactgagctgaagatggattttttaagggaaagagaactaagggaaacacttgagaagcagttggctatggaacaaaagaatagagccatagttcaaaagaggctaaagaaggagaagaaggcaaagagaaaattgcaggaagcacttgagtttgagacgaaacggcgtgaacaagcagaacagacgctaaaacaggcagcttcaacagatagtctcagggtcttaaatgactctctgaccccagagatagaggctgaccgcagtggcggcagaacagatgctgaaaggacaatacaagatggaagactgtatttgaaaactactgtcatgtactgaatctttcctgttgaagaaatccatgttatagaaaagaactttgcagtcagacattcgtcatgggaaagttcagaaaaaaataaagtccttttaagggaacttcctgaattttgtgtattaatgttctttaaaagtttaagtattctacaaaaaaaaaaaaagttttctccattgattttcacctgtggttcataccagagacctgagaatgtttgtaaatgtacaagtatcaaagttcttacagttaattactgcaacttgctgctggacaattgtatacagagttaaaggcaggtctgaataagacctagctttgtttttttctaatggaatgaaccattttcctcttctgaaaattctgtatctgagcacatcaagagactcttgtagcagtggttacccagacttacagaattatgtcctccagaaaccagcaagaacacttggaatgaacgaatgaacttgtagggggcatagaggattcttgaaaaaaaaaaatgcaagagtgattttctgttacattcaatttcaaactctctaattgtgggttttctcctgaagaattttttttcacatactttccaaaagaccaacaaatggatgttgacaacaacccaatgaaataacattttgcatatctgaaaagaagcattgaatataagccaaaagctttcactgaaggtttttttttcttaaaaataaaaaaaaa

SEQ ID NO: 124839 - DNA, 2232 bp, Homo sapiens
  Payload ID: 4512
  Gene Symbol: DACH2
  Gene Name: dachshund family transcription factor 2
  Uniprot ID: Q96NX9
  ENST ID: ENST00000373125
  CDS Start-End: 1-1800
atggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccagaaggaagaggcaaatgacaagaaaacaagctgttaacagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaaggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaaacctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaa

SEQ ID NO: 124840 - DNA, 2418 bp, Homo sapiens
  Payload ID: 4512
  Gene Symbol: DACH2
  Gene Name: dachshund family transcription factor 2
  Uniprot ID: Q96NX9
  ENST ID: ENST00000373131
  CDS Start-End: 164-1879
gttgagcttgagcgtgagccggctgctgaagacttgcgaacagttcggagccagcgagagcgcgccagagagagcgagagtgagggagtgagtgcgaggggatctagaggagtcagggcgagaaagcgagggccggaggacccacgatagagacagagtgaccatggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaagcctgaacactgatgccggaactccaactgatcataggcacgaatagggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaaacctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaaaacattttgactttg

SEQ ID NO: 124841 - DNA, 1775 bp, Homo sapiens
  Payload ID: 4512
  Gene Symbol: DACH2
  Gene Name: dachshund family transcription factor 2
  Uniprot ID: Q96NX9
  ENST ID: ENST00000508860
  CDS Start-End: 58-1356
atatgcacccaaagcactcttagttgcagccaaagcagtggaagaaggaagaggcaaatgacaagaaaacaagctgttaacagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaaggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaaacctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaactt

SEQ ID NO: 124842 - DNA, 2494 bp, Homo sapiens
  Payload ID: 4512
  Gene Symbol: DACH2
  Gene Name: dachshund family transcription factor 2
  ENST ID: ENST00000461604
  CDS Start-End: 162-1484
tgagcttgagcgtgagccggctgctgaagacttgcgaacagttcggagccagcgagagcgcgccagagagagcgagagtgagggagtgagtgcgaggggatctagaggagtcagggcgagaaagcgagggccggaggacccacgatagagacagagtgaccatggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccagaaggaagaggcaaatgacaagaaaacaagctgttaacagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggttatgatgcccaacaatagagaggaacttattgttgatcaagataatggactaaccatcaaaaaattccaaaaagataattaagaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaaggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaaacctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaaaacattttgactttgtc

SEQ ID NO: 124843 - DNA, 1764 bp, Homo sapiens
  Payload ID: 4512
  Gene Symbol: DACH2
  Gene Name: dachshund family transcription factor 2
  Uniprot ID: Q96NX9
  ENST ID: ENST00000510272
  CDS Start-End: 175-1317
atatgcacccaaagcactcttagttgcagccaaagcagtggaagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaaggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaaacctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaaaacattttgactttg

SEQ ID NO: 124844 - DNA, 5582 bp, Homo sapiens
  Payload ID: 4512
  Gene Symbol: DACH2
  Gene Name: dachshund family transcription factor 2
  ENST ID: ENST00000484479
  CDS Start-End: 1-750
attgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcaggtcaacaatatttctataaacaaaataaatggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaagcctgaacactgatgccggaactccaactgatcataggcacgaatagggtgctgtagcagttacctgcttatctagtgttgtaaattatttagaattcatactcaaatccttaaaatatggaacctttaattactgtttgttcattactgataaatagaaccttacacatacaggaaaaatgtcctagagaatgggtttcacaggtttttaggggatagtcataataatgactgaacacattttacacttctttaacctctttctttcaaggagttagttcatagtgcttcaaaaacattatcacattaattcacacagaatcctagtggggtaagtaggtggaagaatttttaagacagagaaaatgctatttctaaatggtgtgagacaaattaaaatgcaggcacacctactttaagctgcaattactgtgaaataacttcttgtctgacctggtatttaacaggaattatatcaggtggtgaatcatttgtgcaaatgatcgatatttgttatcactgctttggagctctcatttctaaaagaaacacttggcctgtagtgttctctaagaaaatataaggagctctagtttttagattttaccacacccagtttttcctttgaactgttgatggtggagcaagtcctttaacccctttctactagcacattcctgatttgtaaagaatgcaatgataaaaacagatacccaagctgctaaaaatacccctttactattttcttctctcctcccatccccaatcttgcttcctctttattaagctattaacaagcaaacagaatgaaaaatctataggcataagaaaagagaaagatgggtcagtgagattatggatattttatactgttcactctctggtctagacatagccagattcctaacatgttcaaatgattaggaacatttggcttgaattgcccaggaaatggcctcaaatatttttaactgtttacttagaggagatctgaccattggctgggggcagatacctgttatcattattttgatgcctactaaaaatctaatagagcagcattccaatgtgttatatggtactctaatgatcaaaaagatttaatgctcctcctaaagtgccctccttatattaaacaatatataatccattgtgttgttttcacgtctgccctagcattaagttctgatgtgacagaagcaccaagcatctcctgcaaaaagccaactgagtttttatccattttctagtaagaggttccccatggcagtacatgcaatttctgccggaatggccacccactctaaacacttaaaaatattacattaattcatatcgatgtgacatttcagtaattccaagctctgaaggaatgttttctaaagcataagcatttggattctggtattcttcatgggctgtagaaggtctgcttatatagagtaggtatactgttttagcccaattcagtgaaataatgccaaattagaaataagtcatggagaaggattgaagcaagtcaaataaaaacttttattaatatcaaatatctgaaataaataacagtgacaggtgactaaaaatataacatccaagaaagtctcatcattaaatggaatttccaaattaagttacttcaaaataaactagtgtcttttgtttaaataagtagataagtttaacttaccttgtttgaactatgaggactcctcatgtgtatttttttctggccttttcccatatatctgccttgtttatgatacatgattttagctattccggctcataggcttaggatatataccacagggcaagtctcacatttacttgagtttggagcagctatttgtggcccagtaaagataactcaactgattaggagaggttcatctcctgtgtggagtgtccacactgaccttctgtgtcatggcatatgcccatgtcaggcagtgctgtgctaaaggaaggattacatggacttttgtttttactttaaaaatggtcacatttgtatgtatcaaattcccctttttacctatctgataaatcccaaagcaataaactctgtcagctctccccaaatgtcagtgtgtgtccctctttttaagttctcaagctcggtaacattcccctggagagactttgttagtttctcttcctgatctttaatcttattgacatccagagttcatatcagatcatctctgtttagagctcaagaacaaacccttataagaacatgaaacattccattactaattagctgtttcctgttcctaatgaagcgagcacactgggtctggattaaaattcagctactactcctctctgtttatggttccagatgtttttggtttatgtaggagattactttgacagctactactaagtgataaatcactcatattatagctgaaatgcattttgaaattgaaatgtggcaaactttgagattgctccaaggatcagtgtcagcagttcattactggcatcttccttatgatcattcagcattggcacatgtaaaacagtaaccaaatatgtgtcaacattatacaacatgctacacaggggtctgtttcgctactgtcctcaaaattgggagaaaaagttttactacggtgaaatctcaatttattgtattctggtagaaaagttgattcacttaatattgttttcttcttgctagcctagtttttctttcaatttttgagcagctatgggaactattcctaataggccttgtaagcagacacataaaggatgtgggcaaatatttctgtctctaaataaaggcaagaaataaacataacaaaagtagaaatttttcagaaactgcatttttctaaaggacaaatggtgattgtctttcgctattcattgctgagttcatgtaccctttttaaggggacatagtgtgtgctattgctttccagtttgtaatgttcacagtttgtgttgcatgatttaagctttagctatattgtataaatttcaatcctggtaaaatgactgtcatttcatgtcaaagagctttcctttgacatttaggctgtgtatacaaaggatgaggtagactggaggactgagcaaatatttggtcaattcatcagagtaaatattctcagactccacaaaggagttggaacaattaccagtgtccaaaaattcaagctttgttttcttctggtccctggaaaagtttaagtgaattccatgggcttcttgggaaaatgtctggttgccctctgatgaagtccaaccctccataagtctgactaacccaaaccccaaatcttttattcatctattaccttactacatctttatttttggttctgaggtattatctagaaaattctgccactcaccatgataccttatacacagaaagaataaagattttaaagatattatacacaaggttaaaaaagggtatactttcctcctaataagcttgaccagattgacttaatattttagattagacatattagtccaacaatgataatgtcctctccattatatgtgaaaataaagcacttgactcagaaacattatctttaagtatttctcaagcacaggtaatggatttgtacggattcatccacatttcttttcctacttcttttgtaaccaaaagccaatctttgtgatgtatctaaatagagactcaggttataagccattgctatggaaaataacaaggtttgacaaaaagaggtagaataaatttttttttaaaaatttccaacaataacttttacccacccaaattaaatattatctaactctaggatggcatgggctcttttaatgactatcatttagagggataccggtttgactaaacactgtagctgaaacgatattccaaactagtctcccttcatgcagtatacacagtctcagggttaacccgggagaggaaattttaaatgtacaaagctgtcattatcttagatcataaccagatactcttttccccctgttttggtaaaccacagggatggtatttcagatgcaccattatatacaaaaaaaaaagtaatatagattattacagacattataatatagttcatgaagagcctttatcagtcttcaatgtctccggtgctgtggaaagaagaacagaagctatagcatgaaatttgaaggatctttgaaaactgacagatgaaaatatagaaatgttaagaaatgttaaattttaccaacactaaattgagcctgttacatcagatcattttaggttcctgaagatagaagttttagtatttttaagcacgtatcagaatgactcttcataagaactaacttgttttctttttttttaaggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaaacctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaaaacattttgactttg

SEQ ID NO: 124845 - DNA, 1927 bp, Homo sapiens
  Payload ID: 4512
  Gene Symbol: DACH2
  Gene Name: dachshund family transcription factor 2
  ENST ID: ENST00000506327
  CDS Start-End: 1-528
atggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccagagtttcgctctgttgcccaggctgcagtgcagtggtgtgatcttggctcgctgcaacttccgcctcccaggttcaagggattcttgtgcctcagcctcccgagtagctggaattacagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaaggaggtaactattactgtttagaaatggcacaacagttgtattcagcctgaaaggtcctcgctggctttacataaatgaagatgcttgtgattccagtt

SEQ ID NO: 124846 - DNA, 1731 bp, Homo sapiens
  Payload ID: 4512
  Gene Symbol: DACH2
  Gene Name: dachshund family transcription factor 2
  ENST ID: ENST00000613770
  CDS Start-End: 1-1284
tctgttaacagttcaagacccggcaggccccctaagcgttctttgggagtgttgcaggaaaatgcccgccttctgacccatgcagtcccaggcctcttatcgccaggacttatcactccgacaggtataacagctgcagcgatggctgaggcgatgaaacttcagaagatgaagcttatggctatgaacactcttcagggaaatggaagccaaaatgggaccgaatcagagcctgatgatcttaattctaacacaggtggaagtgaatcctcctgggataaagataagatgcagtctccatttgctgcacctggaccccaacatggaattgctcatgcagccctagctggccagccaggcattgggggtgctccaaccctcaatccactgcagcagaaccacctgctaaccaatagactggatctgccatttatgatgatgcctcatcccctacttccagtcagcttacctcctgcatcagttgccatggcaatgaatcagatgaaccatctcaatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccattcatttttgctgatagtctgtcctccgtggagactctgttgaccaacattcagggtctgctgaaagttgctttggataatgctcgcatccaggagaagcagattcaacaagaaaagaaggagctgcgactggagctctatagagagagagaaattagagaaaaccttgaaagacaacttgcagttgagcttcaaagcagaactactatgcaaaagcgcctgaagaaggagaaaaaaaccaagagaaaattgcaggaagccttggaatttgaatcaaagcgccgggagcaagtggagcaggcacttaagcaagccaccactagtgacagtggcctgaggatgttaaaagatactggaattccagatattgaaatagaaaacaatgggactcctcatgatagtgctgctatgcaaggaggtaactattactgtttagaaatggcacaacagttgtattcagcctgaaaggtcctcgctggctttacataaatgaagatgcttgtgattccagtttatctctgaaactattcaacatggagttatttcagttttgtttatcagcaaagctttgtttactgaaggagctatttaatctatgttacattaaaaaagaaacgcgtgtacattttaaaagcaatgatgtaaactttgttcttgcattagactgaccagtttaaaaatatgaactaaaacctaatggctaaagtaacttgaccatatttgatgcttttctatgctcatttcaacttggctttttgtcttttaaatttttaaaaaatgcagtagtgtgttagagactagaaagttatatgtatggtttccctgttctactatacataacgttaaagtacaccttctttgttaaaaatgtacttgctaaacttcagcgtaaataaaaacattttgactttg

SEQ ID NO: 124847 - DNA, 10765 bp, Homo sapiens
  Payload ID: 4513
  Gene Symbol: DCHS1
  Gene Name: dachsous cadherin-related 1
  Uniprot ID: Q96JQ0
  ENST ID: ENST00000299441
  CDS Start-End: 413-10309
gcggagggcggggggaggggaggggagggggcgcggggccgcggcagcggagctcgcatcctcggcggggcggctgtgcaggaggcggcgcccgggcgtcagcggacggaccgatcgacggccaagggcgcgcggaccgacggcggctgcccggaggggatcgcgggcctcggagacagcgactgcggacgatgcgcggcctcaggccccgcgcgagcgggcgctgcccggggggctgaccgcggccggacggcgccccagcaccgggcgagggagcccgcgtcgcgcggaggtcagggagcctgagctggagccagggccccagtgggacctgacccaaagtctgaggtcaagctgggcccagagcctggcctggagctggagcccaaggcacagctggactacccttgtcatgcagaaggagctgggcattgtgccttcctgccctggcatgaagagccccaggccccacctcctgctaccattgctgctgctgctgctgctgctgctgggggctggggtgccaggtgcctggggtcaggctgggagcctggacttgcagattgatgaggagcagccagcgggtacactgattggcgacatcagtgcggggcttccggcaggcacggcagctcctctcatgtacttcatctctgcccaagagggcagcggcgtgggcacagacctggccattgacgaacacagtggggtcgtccgtacagcccgtgtcttggaccgtgagcagcgggaccgctaccgcttcactgcagtcactcctgatggtgccaccgtagaagttacagtgcgagtggctgacatcaacgaccatgctccagccttcccacaggctcgggctgccctgcaggtacctgagcatacagcttttggcacccgctacccactggagcctgctcgtgatgcagatgctgggcgtctgggaacccagggctatgcgctatctggtgatggggctggagagaccttccggctggagacacgccccggtccagatgggactccagtacctgagctggtagttactggggaactggaccgagagaaccgctcacactatatgctacagctggaggcctatgatggtggttcacccccccggagggcccaggccctgctggacgtgacactgctggacatcaatgaccatgccccggctttcaatcagagccgctaccatgctgtggtgtctgagagcctggcccctggcagtcctgtcttgcaggtgttcgcatctgatgccgatgctggtgtcaatggggctgtgacttacgagatcaaccggaggcagagcgagggtgatggacccttctccatcgacgcacacacggggctgctgcagttagagcggccactggactttgagcagcggcgggtccatgaactggtggtgcaagcacgagatggtggggctcaccctgagctgggctcggcctttgtgactgtgcatgtgcgagatgccaatgacaatcagccctccatgactgtcatctttctcagtgcagatggctccccccaagtgtctgaggccgccccacctggacagctcgttgctcgcatctctgtgtcagacccagatgatggtgactttgcccatgtcaatgtgtccctggaaggtggagagggccactttgccctaagcacccaagacagcgtcatctatctggtgtgtgtggctcggcggctggatcgagaggagagggatgcctataacttgagggttacagccacagactcaggctcacctccactgcgggctgaggctgcctttgtgctgcacgtcactgatgtcaacgacaatgcacctgcctttgaccgccagctctaccgacctgagcccctgcctgaggttgcgctgcctggcagctttgtagtgcgggtgactgctcgggatcctgaccaaggcaccaatggtcaggtcacttatagcctagcccctggcgcccacacccactggttctccattgaccccacctcaggcattatcactacggctgcctcactggactatgagttggaacctcagccacagctgattgtggtggccacagatggtggcctgccccctctagcctcctctgccacagttagcgtggccctgcaagatgtgaatgataatgagccccaattccagaggactttctacaatgcctcactgcctgagggcacccagcctggaacttgcttcctgcaggtgacagccacagacgcggatagtggcccatttggcctcctctcctattccttgggtgctggacttgggtcctccggatctcccccattccgcattgatgcccacagcggtgatgtgtgcacaacccggaccctggaccgtgaccaggggccctcaagctttgacttcacagtgacagctgtggatgggggaggcctcaagtccatggtatatgtgaaggtgtttctgtcagacgagaatgacaaccctcctcagttttatccacgggagtatgctgccagtataagtgcccagagtccaccaggcacagctgtgctgaggttgcgtgcccatgaccctgaccagggatcccatgggcgactctcctaccatatcctggctggcaacagccccccactttttaccttggatgagcaatcagggctgttgacagtagcctggcccttggccagacgggccaattctgtggtgcagctggagatcggggctgaggacggaggtggcctacaggcagaacccagtgcccgagtggacatcagcattgtgcctggaacccccacaccacccatatttgagcaactacagtatgttttttctgtgccagaggatgtggcaccaggcaccagtgtgggcatagtccaggcacacaacccaccaggtcgcttggcacctgtgaccctttccctatcaggtggggatccccgaggactcttctccctagatgcggtatcaggactgttgcaaacacttcgccctctggaccgggagctactgggaccagtgttggagctggaggtgcgagcaggcagtggagtgcccccagctttcgctgtagctcgggtgcgtgtgctgctggatgatgtgaatgacaactcccctgcctttcctgcacctgaagacacggtattgctaccaccaaacactgccccagggactcccatctatacactgcgggctcttgaccccgactcaggtgttaacagtcgagtcacctttaccctgcttgctgggggtggtggagccttcaccgtggaccccaccacaggccatgtacggcttatgaggcctctggggccctcaggagggccagcccatgagctggagctggaggcccgggatgggggctccccaccacgcaccagccactttcgactacgggtggtggtacaggatgtgggaacccgtgggctggctccccgattcaacagccctacctaccgtgtggacctgccctcaggcaccactgctggaactcaggtcctgcaagtgcaggcccaagcaccagatgggggccctatcacctatcaccttgcagcagagggagcaagtagcccctttggcctggagccacagagtgggtggctatgggtgcgggcagcactagaccgtgaggcccaggaattgtacatactgaaggtaatggcagtgtctgggtccaaagctgagttggggcagcagacaggcacagccaccgtgagggtcagcatcctcaaccagaatgaacacagtccccgcttgtctgaggatcccaccttcctggctgtggctgagaaccagcccccagggaccagcgtgggccgagtctttgccactgaccgagactcaggacccaatggacgtctgacctacagcctgcaacagctgtctgaagacagcaaggccttccgcatccacccccagactggagaagtgaccacactccaaaccctggaccgtgagcagcagagcagctatcagctcctggtgcaggtgcaggatggagggagcccaccccgcagcaccacaggcactgtgcatgttgcagtgcttgacctcaacgacaacagccccacgttcctgcaggcttcaggagctgctggtgggggcctccctatacaggtaccagaccgcgtgcctccgggaacactggtgacgactctgcaggcgaaggatccagatgagggggagaatgggaccatcttgtacacgctaactggtcctggctcagagcttttctctctgcaccctcactcaggggagctgctcactgcagctcccctgatccgagcagagcggccccactatgtgctgacactgagtgctcatgaccaaggcagccctcctcgaagtgccagcctccagctgctggtgcaggtgcttccctcagctcgcttggccgagccgcccccagatctcgcagagcgggacccagcggcaccagtgcctgtcgtgctgacggtgacagcagctgagggactgcggcccggctctctgttgggctcggtggcagcgccagagcccgcgggtgtgggtgcactcacctacacactggtgggcggtgccgatcccgagggcaccttcgcgctggatgcggcctcagggcgcttgtacctggcgcggcccctggacttcgaagctggcccgccgtggcgcgcgcttacggtacgcgctgaggggccgggaggcgcgggcgcgcggctgctgcgagtgcaggtgcaagtgcaggacgagaatgagcatgcgcccgcctttgcgcgcgacccgctggcgctggcgctgccagagaacccggagcccggcgcagcgctgtacactttccgcgcgtcggacgccgacggccccggccccaatagcgacgtgcgctaccgcctgctgcgccaggagccgcccgtgccggcgcttcgcctggacgcgcgcaccggggcgctcagcgctccgcgcggcctggaccgagagaccactcccgcgctgctgctgctggtggaagccaccgaccggcccgccaacgccagccgccgtcgtgcagcgcgcgtttcagcgcgcgtcttcgtcacggatgagaatgacaacgcgcctgtcttcgcctcgccgtcacgcgtgcgcctcccagaggaccagccgcctgggcccgcggccctgcacgtggtagcccgggacccggatctgggcgaggctgcacgcgtgtcctatcggctggcatctggcggggacggccacttccggctgcactcaagcactggagcgctgtccgtggtgcggccgttggaccgcgaacaacgagctgagcacgtactgacagtggtggcctcagaccacggctccccgccgcgctcggccacgcaggtcctgaccgtcagtgtcgctgacgtcaacgacgaggcgcctactttccagcagcaggagtacagcgtcctcttgcgtgagaacaaccctcctggcacatctctgctcaccctgcgagcaaccgaccccgacgtgggggccaacgggcaagtgacttatggaggcgtctctagcgaaagcttttctctggatcctgacactggtgttctcacgactcttcgggccctggatcgagaggaacaggaggagatcaacctgacagtgtatgcccaggacaggggctcacctcctcagttaacgcatgtcactgttcgagtggctgtggaggatgagaatgaccatgcaccaacctttgggagtgcccatctctctctggaggtgcctgagggccaggacccccagacccttaccatgcttcgggcctctgatccagatgtgggagccaatgggcagttgcagtaccgcatcctagatggggacccatcaggagcctttgtcctagaccttgcttctggagagtttggcaccatgcggccactagacagagaagtggagccagctttccagctgaggatagaggcccgggatggaggccagccagctctcagtgccacgctgcttttgacagtgacagtgctggatgccaatgaccatgctccagcctttcctgtgcctgcctactcggtggaggtgccggaggatgtgcctgcagggaccctgctgctgcagctacaggctcatgaccctgatgctggagctaatggccatgtgacctactacctgggcgccggtacagcaggagccttcctgctggagcccagctctggagaactgcgcacagctgcagccttggacagagaacagtgtcccagctacaccttttctgtgagtgcagtggatggtgcagctgctgggcccctaagcaccacagtgtctgtcaccatcacggtgcgcgatgtcaatgaccatgcacccaccttccccaccagtcctctgcgcctacgtctgccccgcccaggccccagcttcagtaccccaaccctggctctggccacactgagagctgaagatcgtgatgctggtgccaatgcttccattctgtaccggctggcaggcacaccacctcctggcactactgtggactcttacactggtgaaatccgcgtggcccgctctcctgtagctctaggcccccgagatcgtgtcctcttcattgtggccactgatcttggccgtccagctcgctctgccactggtgtgatcattgttggactgcagggggaagctgagcgtggaccccgctttccccgggctagcagtgaggctacgattcgtgagaatgcgcccccagggactcctattgtctcccccagggccgtccatgcaggaggcacaaatggacccatcacctacagcattctcagtgggaatgagaaagggacattctccatccagcctagtacaggtgccatcacagttcgctcagcagaggggctagacttcgaggtgagtccacggctgcgactggtgctgcaggcagagagtggaggagcctttgccttcactgtgctgaccctgaccctgcaagatgccaacgacaatgctccccgtttcctgcggccccattatgtggccttccttcctgagtcccggcccttggaggggcccctgctgcaggtggaggcggatgacctggatcaaggctctggaggacagatttcctacagtctggctgcatcccagccggcacgtggattgttccacgtagacccaaccacaggcactatcactaccacagccatcctggaccgtgagatctgggctgaaacacggttggtgctgatggccacagacagagggagcccagccctggtgggctcagctaccttgacggtgatggtcatcgacaccaatgacaatcgccccaccatcccccaaccctgggagctccgagtgtcagaagatgcgttattgggctcagagattgcacaggtaacagggaatgatgtggactcaggacccgtgctgtggtatgtgctaagcccatctgggccccaggatcccttcagtgttggccgctatggaggccgtgtctccctcacggggcccctggactttgagcagtgtgaccgctaccagctgcagctgctggcacatgatgggcctcatgagggccgtgccaacctcacagtgcttgtggaggatgtcaatgacaatgcacctgccttctcacagagcctctaccaggtaatgctgcttgagcacacacccccaggcagtgccattctctccgtctctgccactgatcgggactcaggtgccaacggtcacatttcctaccacctggcttcccctgccgatggcttcagtgttgaccccaacaatgggaccctgttcacaatagtgggaacagtggccttgggccatgacgggtcaggagcagtggatgtggtgctggaagcacgagaccacggggctccaggccgggcagcacgagccacagtgcacgtgcagctgcaggaccagaacgaccacgccccgagcttcacattgtcacactaccgtgtggctgtgactgaagacctgccccctggctccactctgctcaccctggaggctacagatgctgatggaagccgcagccatgccgctgtggactacagcatcatcagtggcaactggggccgagtcttccagctggaacccaggctggctgaggctggggagagtgctggaccaggcccccgggcactgggctgcctggtgttgcttgaacctctagactttgaaagcctgacacagtacaatctaacagtggctgcagctgaccgtgggcagccaccccaaagctcagtcgtgccagtcactgtcactgtactagatgtcaatgacaacccacctgtctttacccgagcatcctaccgtgtgacagtacctgaggacacacctgttggagctgagctgctgcatgtagaggcctctgacgctgaccctggccctcatggcctcgtgcgtttcactgtcagctcaggcgacccatcagggctctttgagctggatgagagctcaggcaccttgcgactggcccatgccctggactgtgagacccaggctcgacatcagcttgtagtacaggctgctgaccctgctggtgcacactttgctttggcaccagtgacaattgaggtccaggatgtgaatgatcatggcccagccttcccactgaacttactcagcaccagcgtggccgagaatcagcctccaggcactctcgtgaccactctgcatgcaatcgacggggatgctggggcttttgggaggctccgttacagcctgttggaggctgggccaggacctgagggccgtgaggcatttgcactgaacagctcaacaggggagttgcgtgcgcgagtgccctttgactatgagcacacagaaagcttccggctgctggtgggtgctgctgatgctgggaatctctcagcctctgtcactgtgtcggtgctagtgactggagaggatgagtatgaccctgtatttctggcaccagctttccacttccaagtgcccgaaggtgcccggcgtggccacagcttgggtcacgtgcaggccacagatgaggatgggggtgccgatggcctggttctgtattcccttgccacctcttccccctattttggtattaaccagactacaggagccctgtacctgcgggtggacagtcgggcaccaggcagcggaacagccacctctgggggtgggggccggacccggcgggaagcaccacgggagctgaggctggaggtgatagcacgggggcctctgcctggttcccggagtgccacagtgcctgtgaccgtggatatcacccacaccgcactgggcctggcacctgacctcaacctgctattagtaggggccgtggcagcctccttgggagttgtggtggtgcttgcactggcagccctggtcctaggacttgttcgggcccgtagccgcaaggctgaggcagcccctggcccaatgtcacaggcagcacccctagccagtgactcactgcagaaactgggccgggagccacctagtccaccaccctctgagcacctctatcaccagactcttcccagctatggtgggccaggagctggaggaccctacccccgtggtggctccttggacccttcacattcaagtggccgaggatcagcagaggctgcagaggatgatgagatccgcatgatcaatgagttcccccgtgtggccagtgtggcctcctctctggctgcccgtggccctgactcaggcatccagcaggatgcagatggtctgagtgacacatcctgcgaaccacctgcccctgacacctggtataagggccgaaaggcagggctgctgctgccaggtgcaggagccactctctacagagaggaggggcccccagccactgccacagccttcctggggggctgtggcctgagccctgcacccactggggactatggcttcccagcagatggcaagccatgtgtggcaggtgcgctgacagccattgtggccggcgaggaggagctccgtggcagctataactgggactacctgctgagctggtgccctcagttccaaccactggccagtgtcttcacagagatcgctcggctcaaggatgaagctcggccatgtcccccagctccccgtatcgacccaccacccctcatcactgccgtggcccacccaggagccaagtctgtgccccccaagccagcaaacacagctgcagcccgggccatcttcccaccagcttctcaccgctcccccatcagccatgaaggctccctgtcctcagctgccatgtcccccagcttctcaccctctctgtctcctctggctgctcgctcacccgttgtctcaccatttggggtggcccagggtccctcagcctcagcactcagcgcagagtctggcctggagccacctgatgacacggagctgcacatctagctgtggcccaggctgggccccgacctgggatgcgcacagtgtccccaacgcaggccccactctgagcctgccctgggcagcctcggactatgactggctacggggaggccaccaccaggccccagctctccaccctgaactccccagccccctcagagtactaggaccacagaagccctgttgctcactgacctgtgaccaggtccaatgtggggagaaatatgaaggaggtagcagccctgggttctcctcagtgagggatccctgccctgcaccagcaccctgagatggagctgagactttatttattgggggtagggggatggaggaggtccctccaacatgtttggacccagctcctttgggttccactgacacccctgcccctgcccctgcccagaaccaagtgccatttctcactctggagccttaataaactgcaatttgtatccagtc

SEQ ID NO: 124848 - DNA, 5064 bp, Homo sapiens
  Payload ID: 4514
  Gene Symbol: DCHS2
  Gene Name: dachsous cadherin-related 2
  ENST ID: ENST00000339452
  CDS Start-End: 362-4471
aataatgcacctgactttaccaggggggaacaaccagccgagtagaacaaggaacagatgtaaagggaataaaaggagagagaaaaagagatgagattcgtttaaagaaatccaggggcagaagaggtggctgccgcggcagaggcagctagagcttacttccctgtctgcgtgagctgcaggcagaggacgctttcaccagttgcagatgtaacctcgggaattcctgggccgtcggtttgtttgccaaacaaagtcttttcttctctggctcagacactgaagaggctcctggatttttctgcgatcctgccacaagctggcagttacccgagagccttcccaaggagctggaggagaaatgagcccttgtgggcggaagatgggcgaagggcgtcagcagcggcgggctccggtcgggaagctccttctgctccccgggaggagagatacaccccatgggcggtcaggcagcagcggcgccaggacgcagcgctccctgctctggctcttggtgcacgtgtggctgtgggcggcctcgggctcctctgcccagttgttcaacctcaccctttccgtagatgaggggcttcccccggacacgctggtaggtgacatccgcgccgggctgccggccgcgcagcagcaggaggggagcggcttctttctgtcggaggactccgatgactccccgctgctggacgacttccacgtgcacccggacaccggcatcatccgcactgcgcggcgcctggaccgcgagcggcgggaccactacagcttcgtcgccgccacgctgctgggcgctgtggtgcaggtggagattcgcgtcaacgacgtgaatgaccactcgccccgctttcccctcgactccctgcaactcgacgtctccgagctcagcccgccagggaccgccttccgcctgccagttgcccacgatccggacgccggactgttcagcactcagggctacaccctggtgcaaccgtccgacctgcccaaggaccccgcaggcccgttcttccagttgcgctaccggactccggggccactaccgtcaccgcttttgccaggctcctcgtcacccctggagcctctagatctggtgctgctgcggcgcttggaccgagaggaggcggcggcgcaccggctgcagatcgaggcatgggacggcggccgaccccggcgcaccggcctcctgagcgtggagctgcgcgtgctggatgagaacgacaacccgccggtctttgagcaggacgagtaccgcgccgcggtgcgcgaggacgcccagccgggcgccgaggtctgtcgcgtgcgcgccaccgaccgcgacctggggcccaatggcttcgtgcgctacagcgtccgcgcccggcaagtgcctggggcgggtagcggcggcggggcactgggcgacgcggcctacttcgcggtggaggagctgagcggcgtggtgcgagtgtggagacctctggaccgcgaggcacaggcctggcaccagttggtggtggaggcccgcgatggaggcgccgagcctgaggttgccacggtgcgcgtgtccatcgccgtgctggacgtgaatgacaaccggccagcaattcacgtgctctttctcacagagggaggcgtcgcccgtgtctctgaaggcgcccgaccgggcgactacgtggctcgcgtctcggtgtctgacgcggacggtgactgggagaaggaagatgaggccacaggggagcttggtgtgggtcttggagacgggagcatctctctgtccttggaaggcggagagggagacttcgcgttgctacccggcggccccccaggggtatttttcctttgcgtggaggggcccctggacagagagagccgcgatctgtatgagttactactggtggccacggacgcggggtccccgccgctgagcacggaggagacgctgctactccgggtcgctgacctcaatgaccaaccacctctcttcagccaacagcattacaaggcctcagtgtccgaggccgcggcccctggcactgtagtcatgtgggtcagcgcctccgatgccgacgaggcaggcagtgatcacgcctggctgcgctacactgtagtccaactctcggctccctgcaatctcggctccctgcaatcaaagatggtccacaccgcagagtgtggaccatcttttgccattgattccgaaagcggtgcgatcagcactatccggactctagaccgagaggtccaggaggcggtggagctgaaagtggtggcccaggacctcggagagcccccactctctgccacctgcctggtgagcatcaccgtagatgatgtgaatgacaatgagcccatcttctggaggcaggtgtacaatgccaccattgcagagcatgccccggttggacactgctttctgcaggtgacagcctctgatgcagattcaggactctatggctttattgaatattctctttatgatggattcctgagctatgaagcacctcaggcattccggatcgaccctcatgatgggcaaatctgtgtttctcaagatatcgacagggaaagggatccagctacctatgatctcctggtggaagctaaggatgggggtgggctaagtgcccaagcctttgttcgtgtggacctggaggacgtgaatgataatcatcctgtgtttaacccatcaacctatgtgacgagcatcagtgatgagacccagccaggcaccgagatcatcaatgttcttgccactgaccaggactctgggatatatgggacagtggcttatgagcttattccaggaaacgtgtcgtccctttttaccattgactccaccacaggaattatttacttaacattacctcttagtcatttggaatctaccacactttcgttgatggtctctgctcaagacggtggtgggctcacagctgtcattaatgccgatgtcaccatacacattttccagacaactctggcacctgctgagtttgaaaggcctaagtacactttcttagtttatgaagatgtgcctgaagatagtcccattggaacagtgaaagcaagagagcccttgaactcctcagaaccaatcttttacaggatttcttctggtgatctcggcggaaagttctccattcacccgcggctgggcactattcgcacccggaagcccctggatcacgagacgcagcccgtggttgtgctcacggtgcaggcgcagctcggcagcgccccagcctgcagcagcaccgaggtcaacataacagtcatggatgtcaatgacaaccacccagcgttcctcaggacctcggatgagattagaatatcccagaccacgccccctggcacagccttgtacctcgcacgtgcggaagacagagacagtgggcggaacggactcatccggtactccatcgccagcccgcagccaggcgtctttgccatcgacagagccctgggggtgctgttcctcaacggcagcctgggcgcgggcgagcagcgggagctcacgctgactctcagggccgaggaccaaggcgtgcatcctcaggcagccctgctggtgctgacagtcgttatcgagaaacgcgaacacagcccatcctggactttcgaacatttggtctatcaagtggaagtcagtgagtctctctcaccgatgacacaaatgctgcaaacacaggcgcacccacttggcccccagcgtgcagcctcgcctcttaggtactcgctggaacccagcgtagactctgctatgtttggaatccgcccttacacgggctggatttatttgcggcgacagtttgactatgaatccacccaaacatataattttagagtgtttgcttggatccccgaggacggattcttgcaaaatgtgagcactacagtcattgttcgtgtctgggatgagaatgacaattcccccaccttcttgcatgatgtgttgtttttgaaagtcgaagagagccctgttccccaaggggtaataggcaaaattacagctattgacatggactctggaaagaatggacagctattatatttccttttgtctgatggaaaattcttcaagatgaatcctaatacaggagagttaatcaattgggtggcactggatcgtgagcaccgggggcaccatgagatgactgtgctagtgacagaccgcggctccccaccacgaaacgccaccatggcggtttacgtctcagttactgacatcaatgataacaggcccttcttcccccagtgtctccctggaaaggagttacacgtgaaggttctggaaggtcaaccagtaaatatgttggttacaactgtgtttgcaaaggatcctgatgaaggaaataatgcagaagttacatactcagtatcttcagctagacctatgcctctgaagggaaaaacagcatttgggaagcagtcgtgcaaaaaacaaacaaacaaacaaacaaacaaaatcctgacctgaatctggtcagttctctagatctgcctcccaatttaaggaaaacataagaatagaggaacatattatgctacacgttggagatgcaacagcaaatctagatcatggaaaatgtcaggatacaagttccagtttattcaacaaataaattgcaaggacaaatagagagatgggtggcaggaatccatagattaaagaaatatgcaatatatggactttattttgatcttaatgtaaacaagaaaaataaagagtatttatgggatggttgaaaatttgaaaacttactgaatatttggtgatactgtgaaccattattaatttttaaggtataatatggtactgtgatgattgtgttaaaatatttattttttaaagatgcattttgaaatatatacagaagaaataatatgacttctggaacttacttcaaaaaaaatgggagaagcgaagtatatacatggggaatagatgaaataagattggccatgagctgatcattgttgaagctaggtgatggactcgtgaaagtttattataccattttgtccacttttttgtatgcattttccataataaaaatttttaaaaagtga

SEQ ID NO: 124849 - DNA, 11249 bp, Homo sapiens
  Payload ID: 4514
  Gene Symbol: DCHS2
  Gene Name: dachsous cadherin-related 2
  ENST ID: ENST00000357232
  CDS Start-End: 1-8750
tgagactggatgagataacgaaatcagagaatgaagacggagaaaagaagatgtttactcagcagtttgaaagtactgatgcctgtgtatatgaggtgtatgtgaaaataaattccattgtgaaatctcagagtcagtgtggattgaaaagaggtagtcccgagactgagctctggggtgctatagtgttcagaagccaggaagagaacgcaaaaccagtgaaggaaactgaggtgacagcctctgatgcagattcaggactctatggctttattgaatattctctttatgatggattcctgagctatgaagcacctcaggcattccggatcgaccctcatgatgggcaaatctgtgtttctcaagatatcgacagggaaagggatccagctacctatgatctcctggtggaagctaaggatggggatgagcagagaatgacacatttagccctggtgaagggtgggctaagtgcccaagcctttgttcgtgtggacctggaggacgtgaatgataatcatcctgtgtttaacccatcaacctatgtgacgagcatcagtgatgagacccagccaggcaccgagatcatcaatgttcttgccactgaccaggactctgggatatatgggacagtggcttatgagcttattccaggaaacgtgtcgtccctttttaccattgactccaccacaggactctatagtccagaggtagaaattctgagtgctgtcaacttttcagcagacaaggaagtaatgaacagtttagagatgtttttacctctgctaaggcacttcaagaaggttgaaagagatgaggaagctgcagaaaaaaaatttgaagctagcagaggttggttcatgaggtttaagggaagacgccatctccattacctaaaagtgcaagatgaagcagcaagtgctgatggagaagctgcagcaaggtatgtagcaaatctagctaagattcttggtgaaggaattatttacttaacattacctcttagtcatttggaatctaccacactttcgttgatggtctctgctcaagacggtggtgggctcacagctgtcattaatgccgatgtcaccatacacattttccagacaactctggcacctgctgagtttgaaaggcctaagtacactttcttagtttatgaagatgtgcctgaagatagtcccattggaacagtgaaagcaagagagcccttgaactcctcagaaccaatcttttacaggatttcttctggtgatctcggcggaaagttctccattcacccgcggctgggcactattcgcacccggaagcccctggatcacgagacgcagcccgtggttgtgctcacggtgcaggcgcagctcggcagcgccccagcctgcagcagcaccgaggtcaacataacagtcatggatgtcaatgacaaccacccagcgttcctcaggacctcggatgagattagaatatcccagaccacgccccctggcacagccttgtacctcgcacgtgcggaagacagagacagtgggcggaacggactcatccggtactccatcgccagcccgcagccaggcgtctttgccatcgacagagccctgggggtgctgttcctcaacggcagcctgggcgcgggcgagcagcgggagctcacgctgactctcagggccgaggaccaaggcgtgcatcctcaggcagccctgctggtgctgacagtcgttatcgagaaacgcgaacacagcccatcctggactttcgaacatttggtctatcaagtggaagtcagtgagtctctctcaccgatgacacaaatgctgcaaacacaggcgcacccacttggcccccagcgtgcagcctcgcctcttaggtactcgctggaacccagcgtagactctgctatgtttggaatccgcccttacacgggctggatttatttgcggcgacagtttgactatgaatccacccaaacatataattttagagtgtttgcttggatccccgaggacggattcttgcaaaatgtgagcactacagtcattgttcgtgtctgggatgagaatgacaattcccccaccttcttgcatgatgtgttgtttttgaaagtcgaagagagccctgttccccaaggggtaataggcaaaattacagctattgacatggactctggaaagaatggacagctattatatttccttttgtctgatggaaaattcttcaagatgaatcctaatacaggtccagcaggcaccatctatgtcataacctgggcagatggtgctgctgcctttagtgggacagactttgcattcagttctgatgaacttcaagcctttgttctcaagtctctgttctgtgaattaggagaaggagagttaatcaattgggtggcactggatcgtgagcaccgggggcaccatgagatgactgtgctagtgacagaccgcggctccccaccacgaaacgccaccatggcggtttacgtctcagttactgacatcaatgataacaggcccttcttcccccagtgtctccctggaaaggagttacacgtgaaggttctggaaggtcaaccagtaaatatgttggttacaactgtgtttgcaaaggatcctgatgaaggaaataatgcagaagttacatactcagtatcttcagaagatagttctgatcactttaagattgacgccaacaatggtgaaataagaacaaccacaatactttcgtatgattatagaccttcctacagaatgagtgtcattgccactgaccagggagtgcctcctcttcaaggacaggcagttgttaatattcaggtgatcccactatccaaagggagagcaatcatgtctcagaatattagacatttaattataccagaaaatttgaagcccacaaaaataatgagcttgataaagtcatctgatcaccttcaacaacattataatggaaagttacattttagtattgttgcagatgataaggatggacactttgaaatagacagctcaaccggagacttgtttctttctaaggaacttgattatgagacgacatctcattatcttttcagagtgattactacagaccatagcaaaaacctttccctgagtagcacagtcttccttagtatcgatgtggaagatcagaatgaccattccccatctttccaggatgagctcattgtgatcagtgtagaggagaatgttcccataggaaccctggtgtatgtcttcaatgccaaagatgatgacggcagttttttgaacagtagaatacaatactacattgaatcccacaaccctggcacgaatccatttctcatccacccctcatttggcacactagtcactgtgtcccgtcttgacagagaaagcattccaactgtcatcctgacagtaacagcatctgatcaggctgtgaatgtgacagaccggcgactgagatcactgacagcacaaatagtgattttggatgtaaatgaccacaaccccacttttatttctttccccaatgcccatgtcaaagaggatgtcacagtgggctccttggtccaccacataactgctcacgatccagacgaaggaaggaatggaaaagtaacatacagcatcctctcaggaaatgaaaacatgacgtttatgctagatgagtcatcaggcttactaaccacaacctgtcctttggattatgaaatgaaaactcagcatattctgactgttctggcactggatgatggcacaccagcactttcttcatcccagactttgacagttactgttcttgatgtaaatgatgaagctccagtatttaagcagcacctgtatgaagcctcagtgaaagaaaaccaaaatccaggggagtttgttaccagggttgaagctctggacagagattcaggagtcaattccaagcttcagtttgaaatcatgccaggtgcttcatttgaattattcgagataaattctgacactggagaggtagtgacaaccaccatacttgacagagaaattcaagaagtcttcacccttcgagtactagtacgagatgggggattcccttcattgtccagcaccacaacaatcctctgcactgttgaagatgaaaacgatcacgcaccagagtttattgtttccagttatgacattgaggttctggaaaaccaggaaccagaggttgtctatacggttttagcctctgatatggatgctggcaataacagagctgttgaatatcacataattgatggaaatactgatgagtgctttactataaatgagatgtcaggagaactctcaaccactcgtgctttggaccgggagcaaatcagcaattttacccttgtcattctgtgctctgacctgggagatccacctaggagctctgtaatacacctgcaagttagagttttggatgccaatgaccacagtccttcttttcccacactttattaccagtcctctgtgagagaagatgctgaagtgggaacagtggttcttgtgctttcagctgtggacaaggatgaaggcctgaatgggcaaactgagtattttctgactgatgaggcttctggtgcattcaccattgatcctatgtcaggcacattgaaaaccagcaacaccctcgaccgtgaagccagatctcagcatacatttagtgctgtggccagagactgtagcatccagggttcacgaagcaccactgtaattataaaagtatatgtcactgatgttaatgacaatgatccagttttggaacagaacccttttgatgtgtttctttcccccgagtcgcctacaaaccagacaactgtcattgtgagagctgatgacctggacttggggcccaatggaactgtggtttttagttttgcagagacccagtcaatgttttctattgataaatacacaggagaaattcaatttcagcaaaatccatcttcagaatacttccctatctggctgcagttaaaagttacagaccagggcattccagccaggacaaccacgggtctcttggtcattcacatggaaggagaagatgtaaagatttccttcagccaccacctgtataaagggctcgtgactgaaaattgtgaggcaggtacttctattgtgactgttaaagcttttgctcctgactcaattcaggacagcatgaaatattcaatttttagtggaaatgaagatggagttctttccctgtgctctaagtcaggacaactcactgtgaaagaacccaagtttcttgattttgaagtcagaaatgaggttcaactcatcgttttagctgaaagtagtgggcatagagcctattgcaaagtagcagtcttgatacaggatgagaatgataattcaccatgctttgaacaaagcatttaccaggcatcagtgtctgaaagccaactctacaatgctcatgtcatacaggtttttgctaccgacttggacagtggtttgaacggcctgattgagtattctattctgtctggcaaccaagaagaagcattccagattgatgcactgagtggtgtgataacaacaaaagcgattctagattacgagctcaccagctcctacagcttgattgtccaagccacagataaagggatgcccaggctttctaatacgactgtaatcaaggtacaggtgactgatataaatgacaatgccccagcttttctcccctctgaagcagtggaaattacagaagattctttgcctggtgtaattgtgactcatgtgtcagttcatgatgtggatttgaattcagctttcatattcagttttgccaaagagagtaatcctggaaccaagtttgctattgatcagaacactggagtggtggtgttggtgaaaacattggattttgaagaaatgactgaatatgagctgctcatccaaatttctgattcagtgcactacacagagggagcacttgtagtccgtgtgctggatgtcaatgataatccaccagtgttttctcaagatttctatcaggtcacagttcctgaatcaatacctgtggggtattcagtgctgactctgtcagccacagacttagaaagcaatgagaacatttcttacagaattctatcctcttctaaggaattctccattgatcctaagaatggcacaatatttactatcagtcccgtattacttctggatacaatatcaacaactcaatttcttgtggaagccagtgatggtggaaatcctgacctgagagctcttactttagtggagataggaatagaagatatgaacaattatgcccctgaattcacagtcaaatcctataatcttagcctaagtgaggatgctctggttggaagcacgcttgttacattttcaaacatcgaccatgactggacccgtgaaaacacatatgttgaatattccatcatcagtggtaattcacagaacaattttcatgtggaaactaagttctttcattcagaatatccttataagcaagtcggttatcttgtgttgcttcacagtctggacagagaagcaagtgctagccatgagcttgtcattctggcatctgacagtggctgccctccattgagttccacagctgtcatatcaatacaagtacttgatgtcaatgacaatcccccaaacttcagcagcctgagctatcacacccatgtcaaggaaagcacccctctagggagtcacatcactgtggtctcagcaaatgaccgtgacacagggtcacatgcagaaatcatctacaacatcatctctggaaatgagaagggacatttttacttagaagaaaacactggagttctttatttgattaaacctctggattatgaaaaaatgacaaaattcaccttaactgtccaagcttcagatgcagaaaagaaacatttttcttttgcagttgtgtttgtcagtgtcctggatgataacgaccatgcacctcagtttatgttctcaagcttcagctgtattgttccagaaaatctgcctatttcctctaccatatgctctataaatgctctggattttgatgctggtccgtatggagaattgacctattctattgtatcaccctgttttctcactcatggaatgtcttatgatcatgatctcttcctcattgaccctttgacaggggatattcatgctaagcaaatccttgactatgaaaatggcaataaatactgcctcacagtccaagccaaagacaaaggtgatgcaactgcctccttagtggtctgggtggatattgaagggatagatgaatttgagcccattttcactcaagatcagtattttttcaccctcccagaaaagaataaagacagacagttgattggcagagtggaagcctcagatgcagatgctggtattgatggagtcattctttactcccttggaacctcatctcctttcttttcagtaaataaaaccaatggaaatatttatttgattagagcccttcccctaataaaaagtcaactcaacaaagaagacaccttggaaatgaaaataatcgctcatagtcccaaatcagattccaagtttgcatcttgcactgtttttgtgaatgtgtctttctcctctgaaggaacacccttggcagtgttcgccagcagcttttcaatcagcctggtggtctcctttttagtgtttctgatactcatctgcattctaattgtaatgattttaagacataaacaaaaagacacaataaacaattatgaggagaagaaaacctcatctttagatgcggacttgagagtgacccgggatgccagtgtgctcaaagccttccagaaaactgacgactgcagtaacgaggtggtccctgtggatgccactccggaatggttgagtttaataagtatcatggagaaggatattgtcaatctgtacagacactcaaactccagtggccactgttctgtggaaggagaaactgcagaagataaggaaatccagaggataaatgagcatccctacagaaagtgctcagactcagctctgagtgaccacgagtccagggtgccagactcgggtatcccgagggactcagaccagctctcctgcctatctggggaaactgatgtgatggtgactgccgaaacagcagaagccagccaaacatttggggaaggagatcaaggggaaggctgcagcaccacctgtgctcaaaataatgtgttaccccagacagttcagaagagagaggcaaaagagagcatcctggctgacgttagaaaagagtctgtctttatttcaggtgatcaggaagtaaggtgtgcagctctttcaactcagacgacctctgatcatgatggaaaagacaactatcactggaattatcttcttagttgggagcccaaattccaacctcttgcctcagtatttaatgatattgcaaaactaaaggatgaacatttgcatatgcctggcattccaaaagagaagaaatcttttgtttttccaccccctttgataacagcagtagcccagcctgggattaaagcagtcccaccaagaatgccggcagtaaacctggggcaggtgcctccgaaacacccacgctctcccatcccctaccatcttggttctctgccagaaggcatgactcccaatttttctccatctctttccctattgacgatgcagcctcctgccttgtctccactgttgagagaaggagaattattaggaacacacatcagtggtacatgccatgaacttaaagcagaagatgaagttcaaatatgaaaccactgggatgccaagtacctgctcaccattggtcatgaatgaatgaacaaaatgttttcaagccagcaactcgagattgggctcatttttatctaaaagcaagtgatgtaatttagttagagtttttaaaacttccccattaaagtttctccaatttcttccagccttaatgaaaagttatttcctcttttaatccttatgtgttgctctcaggactcacatttgtatatattaagtagtgtatattctgtcagacctgttgtctgtatgattagacttccaaaggacacagtgaacttaactgactgccagaatgtttatatggaaacaaaatatagtgtactctggtcacattgctgctgatcacactgctatatcaaaaacaaactagtaaaggctaaatggagaatgagtttaggtcagaacatatagcagagaggggaagtctagaggaataaactttcattttaagataaagcaatagttggtggatctgatatatttagaggagtatttctccatttttccccatataccacacctgtagagtttagccataattgaatttcaatgtggagtcttttggaaaactaataaaaaattcagaaggaaatttgtcataactctgtgacaatagggagaaacaaataggatttataatgataggtaatataaataattattcatgattcaataaaccagaaatgcatgttcctgatagagggccaggattgatactcgcaatatttatgtggtttgctaccacctgaaacatattatcttggccttctttacaaacagaatggcttttttttcaggtcttgtcttataagtaggtgtgggtaaagacattaaacttcaaaggttaatttatagcaatgtcttcattttattttcttctagatacagtaacttttttgtgtgaaataatttatccactcaatgtcagtttttaaaatttgtgtagataaaaatcatgtcattagctaatgataaatctcatagagtaatttagcaatatatttttaaatgaagttttttatggaaatgtttctactataaaagttaagaatagaagtcagaagtctttttaccatttgctcacacacttgcagctttaatttaactgtcattagatggagcagtttggcacatggttaaaatgactctgtacaattactattttagaaatatagcagtgctagatggtgctcacatacaatgctctagccttctttctgataagcctgggaatccctcacagattctcatccctttcaggaaggtggacagcatcctgacgatggtggttcagaagtcctcttcctgtggtcagcatgagggccaggtgttaggctaacagtttaggaattctaatgtgaaatctaaagggtatcgtgtggctttcttagtagttaggatgggcttctactacagatatagttcctttgtgttcttcttccataggcctcatctgtgaaattttgtgacataatttctctttactaaaaaatattgcaaggtgcagtgtttgatgtctggttttgtagataagtaattctacagcttcctatgctgatattttctattatctatctatgctgactgagattgggaacaaatgtataaagctatattacaaattgtatgaaacatgaaggtttttgaataagcctgaaatcctaggaaaaatcctttaggagtagaaaatttaaatactatgggactgatatatgatgtttctccttttcttcctggcatctggggaagaagatttcatgacttatgtaaaaaaaaaacccacacatatttaatcatttatgtgttccagtatttattatctctgactcttttgaaaacattgctttgagcatagaaagaaaccctatactatattttcctaattatatatggaagttttcttttcacaatagaattatttctggaaactaagaacattttgttgtttttaattaaacaggttcttcatttacttatgcttaaaaagagttattcatctacctattccctaagttagttatttattactgtgatttatttactcattatggatgtgattctgtatgttttctagccattgcataacaagagaagacatgtaatagagcttttttaccaatatttaatggatttttaattgatgggtttatcagtctgtatccagtgccacaatgccaccaaacaagtactacaagtgggaatggggttaaaaatgtgaacacgctggttaagtgtttgcaataaatcgtatgtcagctctttcaactagagtgctttttttcctaagtaaacaatataatttgtacatttttccttcaagtttaatattaacttgcctcatatgttctgggttactttgctgatctatgcactggctttagcactctggagggggtacagaacttgttagtggaaaatcatattaagccccaaattcataagctataaaataaaagacagttgtctcttgtggaa

SEQ ID NO: 124850 - DNA, 8912 bp, Homo sapiens
  Payload ID: 4514
  Gene Symbol: DCHS2
  Gene Name: dachsous cadherin-related 2
  Uniprot ID: Q6V1P9
  ENST ID: ENST00000623607
  CDS Start-End: 1-8751
atgagactggatgagataacgaaatcagagaatgaagacggagaaaagaagatgtttactcagcagtttgaaagtactgatgcctgtgtatatgaggtgtatgtgaaaataaattccattgtgaaatctcagagtcagtgtggattgaaaagaggtagtcccgagactgagctctggggtgctatagtgttcagaagccaggaagagaacgcaaaaccagtgaaggaaactgaggtgacagcctctgatgcagattcaggactctatggctttattgaatattctctttatgatggattcctgagctatgaagcacctcaggcattccggatcgaccctcatgatgggcaaatctgtgtttctcaagatatcgacagggaaagggatccagctacctatgatctcctggtggaagctaaggatggggatgagcagagaatgacacatttagccctggtgaagggtgggctaagtgcccaagcctttgttcgtgtggacctggaggacgtgaatgataatcatcctgtgtttaacccatcaacctatgtgacgagcatcagtgatgagacccagccaggcaccgagatcatcaatgttcttgccactgaccaggactctgggatatatgggacagtggcttatgagcttattccaggaaacgtgtcgtccctttttaccattgactccaccacaggactctatagtccagaggtagaaattctgagtgctgtcaacttttcagcagacaaggaagtaatgaacagtttagagatgtttttacctctgctaaggcacttcaagaaggttgaaagagatgaggaagctgcagaaaaaaaatttgaagctagcagaggttggttcatgaggtttaagggaagacgccatctccattacctaaaagtgcaagatgaagcagcaagtgctgatggagaagctgcagcaaggtatgtagcaaatctagctaagattcttggtgaaggaattatttacttaacattacctcttagtcatttggaatctaccacactttcgttgatggtctctgctcaagacggtggtgggctcacagctgtcattaatgccgatgtcaccatacacattttccagacaactctggcacctgctgagtttgaaaggcctaagtacactttcttagtttatgaagatgtgcctgaagatagtcccattggaacagtgaaagcaagagagcccttgaactcctcagaaccaatcttttacaggatttcttctggtgatctcggcggaaagttctccattcacccgcggctgggcactattcgcacccggaagcccctggatcacgagacgcagcccgtggttgtgctcacggtgcaggcgcagctcggcagcgccccagcctgcagcagcaccgaggtcaacataacagtcatggatgtcaatgacaaccacccagcgttcctcaggacctcggatgagattagaatatcccagaccacgccccctggcacagccttgtacctcgcacgtgcggaagacagagacagtgggcggaacggactcatccggtactccatcgccagcccgcagccaggcgtctttgccatcgacagagccctgggggtgctgttcctcaacggcagcctgggcgcgggcgagcagcgggagctcacgctgactctcagggccgaggaccaaggcgtgcatcctcaggcagccctgctggtgctgacagtcgttatcgagaaacgcgaacacagcccatcctggactttcgaacatttggtctatcaagtggaagtcagtgagtctctctcaccgatgacacaaatgctgcaaacacaggcgcacccacttggcccccagcgtgcagcctcgcctcttaggtactcgctggaacccagcgtagactctgctatgtttggaatccgcccttacacgggctggatttatttgcggcgacagtttgactatgaatccacccaaacatataattttagagtgtttgcttggatccccgaggacggattcttgcaaaatgtgagcactacagtcattgttcgtgtctgggatgagaatgacaattcccccaccttcttgcatgatgtgttgtttttgaaagtcgaagagagccctgttccccaaggggtaataggcaaaattacagctattgacatggactctggaaagaatggacagctattatatttccttttgtctgatggaaaattcttcaagatgaatcctaatacaggtccagcaggcaccatctatgtcataacctgggcagatggtgctgctgcctttagtgggacagactttgcattcagttctgatgaacttcaagcctttgttctcaagtctctgttctgtgaattaggagaaggagagttaatcaattgggtggcactggatcgtgagcaccgggggcaccatgagatgactgtgctagtgacagaccgcggctccccaccacgaaacgccaccatggcggtttacgtctcagttactgacatcaatgataacaggcccttcttcccccagtgtctccctggaaaggagttacacgtgaaggttctggaaggtcaaccagtaaatatgttggttacaactgtgtttgcaaaggatcctgatgaaggaaataatgcagaagttacatactcagtatcttcagaagatagttctgatcactttaagattgacgccaacaatggtgaaataagaacaaccacaatactttcgtatgattatagaccttcctacagaatgagtgtcattgccactgaccagggagtgcctcctcttcaaggacaggcagttgttaatattcaggtgatcccactatccaaagggagagcaatcatgtctcagaatattagacatttaattataccagaaaatttgaagcccacaaaaataatgagcttgataaagtcatctgatcaccttcaacaacattataatggaaagttacattttagtattgttgcagatgataaggatggacactttgaaatagacagctcaaccggagacttgtttctttctaaggaacttgattatgagacgacatctcattatcttttcagagtgattactacagaccatagcaaaaacctttccctgagtagcacagtcttccttagtatcgatgtggaagatcagaatgaccattccccatctttccaggatgagctcattgtgatcagtgtagaggagaatgttcccataggaaccctggtgtatgtcttcaatgccaaagatgatgacggcagttttttgaacagtagaatacaatactacattgaatcccacaaccctggcacgaatccatttctcatccacccctcatttggcacactagtcactgtgtcccgtcttgacagagaaagcattccaactgtcatcctgacagtaacagcatctgatcaggctgtgaatgtgacagaccggcgactgagatcactgacagcacaaatagtgattttggatgtaaatgaccacaaccccacttttatttctttccccaatgcccatgtcaaagaggatgtcacagtgggctccttggtccaccacataactgctcacgatccagacgaaggaaggaatggaaaagtaacatacagcatcctctcaggaaatgaaaacatgacgtttatgctagatgagtcatcaggcttactaaccacaacctgtcctttggattatgaaatgaaaactcagcatattctgactgttctggcactggatgatggcacaccagcactttcttcatcccagactttgacagttactgttcttgatgtaaatgatgaagctccagtatttaagcagcacctgtatgaagcctcagtgaaagaaaaccaaaatccaggggagtttgttaccagggttgaagctctggacagagattcaggagtcaattccaagcttcagtttgaaatcatgccaggtgcttcatttgaattattcgagataaattctgacactggagaggtagtgacaaccaccatacttgacagagaaattcaagaagtcttcacccttcgagtactagtacgagatgggggattcccttcattgtccagcaccacaacaatcctctgcactgttgaagatgaaaacgatcacgcaccagagtttattgtttccagttatgacattgaggttctggaaaaccaggaaccagaggttgtctatacggttttagcctctgatatggatgctggcaataacagagctgttgaatatcacataattgatggaaatactgatgagtgctttactataaatgagatgtcaggagaactctcaaccactcgtgctttggaccgggagcaaatcagcaattttacccttgtcattctgtgctctgacctgggagatccacctaggagctctgtaatacacctgcaagttagagttttggatgccaatgaccacagtccttcttttcccacactttattaccagtcctctgtgagagaagatgctgaagtgggaacagtggttcttgtgctttcagctgtggacaaggatgaaggcctgaatgggcaaactgagtattttctgactgatgaggcttctggtgcattcaccattgatcctatgtcaggcacattgaaaaccagcaacaccctcgaccgtgaagccagatctcagcatacatttagtgctgtggccagagactgtagcatccagggttcacgaagcaccactgtaattataaaagtatatgtcactgatgttaatgacaatgatccagttttggaacagaacccttttgatgtgtttctttcccccgagtcgcctacaaaccagacaactgtcattgtgagagctgatgacctggacttggggcccaatggaactgtggtttttagttttgcagagacccagtcaatgttttctattgataaatacacaggagaaattcaatttcagcaaaatccatcttcagaatacttccctatctggctgcagttaaaagttacagaccagggcattccagccaggacaaccacgggtctcttggtcattcacatggaaggagaagatgtaaagatttccttcagccaccacctgtataaagggctcgtgactgaaaattgtgaggcaggtacttctattgtgactgttaaagcttttgctcctgactcaattcaggacagcatgaaatattcaatttttagtggaaatgaagatggagttctttccctgtgctctaagtcaggacaactcactgtgaaagaacccaagtttcttgattttgaagtcagaaatgaggttcaactcatcgttttagctgaaagtagtgggcatagagcctattgcaaagtagcagtcttgatacaggatgagaatgataattcaccatgctttgaacaaagcatttaccaggcatcagtgtctgaaagccaactctacaatgctcatgtcatacaggtttttgctaccgacttggacagtggtttgaacggcctgattgagtattctattctgtctggcaaccaagaagaagcattccagattgatgcactgagtggtgtgataacaacaaaagcgattctagattacgagctcaccagctcctacagcttgattgtccaagccacagataaagggatgcccaggctttctaatacgactgtaatcaaggtacaggtgactgatataaatgacaatgccccagcttttctcccctctgaagcagtggaaattacagaagattctttgcctggtgtaattgtgactcatgtgtcagttcatgatgtggatttgaattcagctttcatattcagttttgccaaagagagtaatcctggaaccaagtttgctattgatcagaacactggagtggtggtgttggtgaaaacattggattttgaagaaatgactgaatatgagctgctcatccaaatttctgattcagtgcactacacagagggagcacttgtagtccgtgtgctggatgtcaatgataatccaccagtgttttctcaagatttctatcaggtcacagttcctgaatcaatacctgtggggtattcagtgctgactctgtcagccacagacttagaaagcaatgagaacatttcttacagaattctatcctcttctaaggaattctccattgatcctaagaatggcacaatatttactatcagtcccgtattacttctggatacaatatcaacaactcaatttcttgtggaagccagtgatggtggaaatcctgacctgagagctcttactttagtggagataggaatagaagatatgaacaattatgcccctgaattcacagtcaaatcctataatcttagcctaagtgaggatgctctggttggaagcacgcttgttacattttcaaacatcgaccatgactggacccgtgaaaacacatatgttgaatattccatcatcagtggtaattcacagaacaattttcatgtggaaactaagttctttcattcagaatatccttataagcaagtcggttatcttgtgttgcttcacagtctggacagagaagcaagtgctagccatgagcttgtcattctggcatctgacagtggctgccctccattgagttccacagctgtcatatcaatacaagtacttgatgtcaatgacaatcccccaaacttcagcagcctgagctatcacacccatgtcaaggaaagcacccctctagggagtcacatcactgtggtctcagcaaatgaccgtgacacagggtcacatgcagaaatcatctacaacatcatctctggaaatgagaagggacatttttacttagaagaaaacactggagttctttatttgattaaacctctggattatgaaaaaatgacaaaattcaccttaactgtccaagcttcagatgcagaaaagaaacatttttcttttgcagttgtgtttgtcagtgtcctggatgataacgaccatgcacctcagtttatgttctcaagcttcagctgtattgttccagaaaatctgcctatttcctctaccatatgctctataaatgctctggattttgatgctggtccgtatggagaattgacctattctattgtatcaccctgttttctcactcatggaatgtcttatgatcatgatctcttcctcattgaccctttgacaggggatattcatgctaagcaaatccttgactatgaaaatggcaataaatactgcctcacagtccaagccaaagacaaaggtgatgcaactgcctccttagtggtctgggtggatattgaagggatagatgaatttgagcccattttcactcaagatcagtattttttcaccctcccagaaaagaataaagacagacagttgattggcagagtggaagcctcagatgcagatgctggtattgatggagtcattctttactcccttggaacctcatctcctttcttttcagtaaataaaaccaatggaaatatttatttgattagagcccttcccctaataaaaagtcaactcaacaaagaagacaccttggaaatgaaaataatcgctcatagtcccaaatcagattccaagtttgcatcttgcactgtttttgtgaatgtgtctttctcctctgaaggaacacccttggcagtgttcgccagcagcttttcaatcagcctggtggtctcctttttagtgtttctgatactcatctgcattctaattgtaatgattttaagacataaacaaaaagacacaataaacaattatgaggagaagaaaacctcatctttagatgcggacttgagagtgacccgggatgccagtgtgctcaaagccttccagaaaactgacgactgcagtaacgaggtggtccctgtggatgccactccggaatggttgagtttaataagtatcatggagaaggatattgtcaatctgtacagacactcaaactccagtggccactgttctgtggaaggagaaactgcagaagataaggaaatccagaggataaatgagcatccctacagaaagtgctcagactcagctctgagtgaccacgagtccagggtgccagactcgggtatcccgagggactcagaccagctctcctgcctatctggggaaactgatgtgatggtgactgccgaaacagcagaagccagccaaacatttggggaaggagatcaaggggaaggctgcagcaccacctgtgctcaaaataatgtgttaccccagacagttcagaagagagaggcaaaagagagcatcctggctgacgttagaaaagagtctgtctttatttcaggtgatcaggaagtaaggtgtgcagctctttcaactcagacgacctctgatcatgatggaaaagacaactatcactggaattatcttcttagttgggagcccaaattccaacctcttgcctcagtatttaatgatattgcaaaactaaaggatgaacatttgcatatgcctggcattccaaaagagaagaaatcttttgtttttccaccccctttgataacagcagtagcccagcctgggattaaagcagtcccaccaagaatgccggcagtaaacctggggcaggtgcctccgaaacacccacgctctcccatcccctaccatcttggttctctgccagaaggcatgactcccaatttttctccatctctttccctattgacgatgcagcctcctgccttgtctccactgttgagagaaggagaattattaggaacacacatcagtggtacatgccatgaacttaaagcagaagatgaagttcaaatatgaaaccactgggatgccaagtacctgctcaccattggtcatgaatgaatgaacaaaatgttttcaagccagcaactcgagattgggctcatttttatctaaaagcaagtgatgtaatttagttagagtttttaaaacttccccattaaagtttctccaatttc

SEQ ID NO: 124851 - DNA, 1266 bp, Homo sapiens
  Payload ID: 4515
  Gene Symbol:
  Gene Name: DADB-110M10.7
  ENST ID: ENST00000428105
  CDS Start-End: 4-1152
cccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcgctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagagaaacatccttctgtgagtcattaaaatctatgaaccactct

SEQ ID NO: 124852 - DNA, 1264 bp, Homo sapiens
  Payload ID: 4516
  Gene Symbol:
  Gene Name: DADB-127H9.10
  ENST ID: ENST00000443952
  CDS Start-End: 119-805
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatc

SEQ ID NO: 124853 - DNA, 807 bp, Homo sapiens
  Payload ID: 4516
  Gene Symbol:
  Gene Name: DADB-127H9.10
  ENST ID: ENST00000443812
  CDS Start-End: 1-639
gactttggttactgtcctcgtgtgtactgtgagaaccagccaatgcttcccattggtgtgctggtcatggtgggcttcacagtaggaaaggttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcactgccctctctgaaaacacccacattctttggtcactgtgatttcttaggcctccgtctgttgtaccactagcatctatatgacttttgtgtaattttctctcttgaactctggtgctgttt

SEQ ID NO: 124854 - DNA, 1256 bp, Homo sapiens
  Payload ID: 4516
  Gene Symbol:
  Gene Name: DADB-127H9.10
  ENST ID: ENST00000615363
  CDS Start-End: 342-1256
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgtttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattgttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctga

SEQ ID NO: 124855 - DNA, 1181 bp, Homo sapiens; identical to SEQ ID NO: 114625
  Payload ID: 4516
  Gene Symbol:
  Gene Name: DADB-127H9.10
  ENST ID: ENST00000614071
  CDS Start-End: 13-699

SEQ ID NO: 124856 - DNA, 827 bp, Homo sapiens
  Payload ID: 4516
  Gene Symbol:
  Gene Name: DADB-127H9.10
  ENST ID: ENST00000612713
  CDS Start-End: 342-827
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgtttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctga

SEQ ID NO: 124857 - DNA, 1968 bp, Homo sapiens
  Payload ID: 4517
  Gene Symbol: DALRD3
  Gene Name: DALR anticodon binding domain containing 3
  Uniprot ID: Q5D0E6
  ENST ID: ENST00000313778
  CDS Start-End: 743-1873
attgtcgctttcgctacccgcggggccgggcgagcgggaagctcggcacagtgggagcctggtggtgggtctcctggggccggtcgcaatgggtttccgggggtcccgcggctgctctgtggaccccttcggcccctggtgctccgggcgctggcagcgtcaccggacaaaggccaccgagcgcgggggtgtccccgaggtggacgcgcgggtttacttcctctccggccccacgggcgcgcttccctcctgacggattccgaagcccgccccaccaccgtcaccgcaccagtggcccaggcttcgtgggaccaacagggctaatcctgccccacggatctaatccggatcgggacccggtcccaggggaggcccccacctccccttctattgttctgtggcccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgtt

SEQ ID NO: 124858 - DNA, 1739 bp, Homo sapiens
  Payload ID: 4517
  Gene Symbol: DALRD3
  Gene Name: DALR anticodon binding domain containing 3
  Uniprot ID: Q5D0E6
  ENST ID: ENST00000341949
  CDS Start-End: 8-1639
ggtcaccatggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttacaaa

SEQ ID NO: 124859 - DNA, 654 bp, Homo sapiens
  Payload ID: 4517
  Gene Symbol: DALRD3
  Gene Name: DALR anticodon binding domain containing 3
  ENST ID: ENST00000438585
  CDS Start-End: 1-554
acccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatgatatgcaagttcctggtacagctcagcatggatttcagctcctactacaaccgggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttacaaa

SEQ ID NO: 124860 - DNA, 881 bp, Homo sapiens
  Payload ID: 4517
  Gene Symbol: DALRD3
  Gene Name: DALR anticodon binding domain containing 3
  ENST ID: ENST00000420952
  CDS Start-End: 1-881
atggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgc

SEQ ID NO: 124861 - DNA, 2014 bp, Homo sapiens
  Payload ID: 4517
  Gene Symbol: DALRD3
  Gene Name: DALR anticodon binding domain containing 3
  ENST ID: ENST00000440857
  CDS Start-End: 704-1864
cccgaggtggacgcgcgggtttacttcctctccggccccacgggcgcgcttccctcctgacggattccgaagcccgccccaccaccgtcaccgcaccagtggcccaggcttcgtgggaccaacagggctaatcctgccccacggatctaatccggatcgggacccggtcccaggggaggcccccacctccccttctattgttctgtggcccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagggtgagtggttgttgctcttcaacagtatcctcccctttccggatctgctgagccggacagcagtgctggactgcacagccccggggctccacattgctgtacgcacagagatggtgaggcatagacaaccaggacactctacactctattctttattctggcctggggcacaagagcaaagagatgggccagtgactcagtctctgtctctagatatgcaagttcctggtacagctcagcatggatttcagctcctactacaaccgggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgtt

SEQ ID NO: 124862 - DNA, 1706 bp, Homo sapiens
  Payload ID: 4517
  Gene Symbol: DALRD3
  Gene Name: DALR anticodon binding domain containing 3
  Uniprot ID: Q5D0E6
  ENST ID: ENST00000441576
  CDS Start-End: 1-1551
atggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctggtgactgaggatctcctctctgtgctggctgagctgcaagaggctctatggcattggcccgaggacagccacccaggcctggctggggcctcagatactggtacaggcggctgcctggttgtacatgttgttagctgtgaggaggagttccagcaacagaagttggacctgctttggcagaagttggttgacaaggctccactcagacagaagcacctcatctgtggccctgtgaaagtagctggtgcacctggcactctgatgactgcccctgagtactacgagttccggcatacccaggtgtgcaaggcctcagcactgaagcatggtggggatctggcacaagacccagcctggacagagatctttggtgttctctctgtggccaccatcaagtttgagatgctgagcacagccccacagagtcagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgagtatcctcccctttccggatctgctgagccggacagcagtgctggactgcacagccccggggctccacattgctgtacgcacagagatgatatgcaagttcctggtacagctcagcatggatttcagctcctactacaaccgggtacacatcctgggggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttacaaa

SEQ ID NO: 124863 - DNA, 839 bp, Homo sapiens
  Payload ID: 4517
  Gene Symbol: DALRD3
  Gene Name: DALR anticodon binding domain containing 3
  ENST ID: ENST00000496568
  CDS Start-End: 623-839
ccggaaggtgctgggctggcagtcgccggccctagggggctggatggtcgagggcgcggggtccaagctcaccagggaagctcaacgggcggacagcgcagcgagggtcgcgctcggtacaagctacgtagcgcgagagcggtggccatggctgaccaacgcgcggcgaagtcgtcaccggcgccgttagtccccgggttgggagggccctgcggagcctgacccagcgtggctgcagcgccccctgcgtcccggagggcaccgcacagctcgaccggcccagcaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacggggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctgg

SEQ ID NO: 124864 - DNA, 1266 bp, Homo sapiens
  Payload ID: 4518
  Gene Symbol:
  Gene Name: DAMA-236L13.19
  ENST ID: ENST00000439683
  CDS Start-End: 4-1152
cccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcgctgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagttcttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagacaaacatccttctgtgagtcattaaaatctatgaaccactct

SEQ ID NO: 124865 - DNA, 1270 bp, Homo sapiens
  Payload ID: 4519
  Gene Symbol:
  Gene Name: DAMA-236L13.20
  ENST ID: ENST00000457089
  CDS Start-End: 119-805
cttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactatcgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccagttcctgttcccgacatccggacgtgccacttctgcctcgtagaagacccttctgtaggatgcatttcaggctcagagaagtgtaccatcagcagctcatccctgtgcatggtgatcaccatctattatgatgtcaaggttcgcttcatcgttcgaggctgtggacagtacatttcctaccgctgccaagaaaaacgcaacacctactttgcagagtactggtatcaggcccagtgctgtcagtacgattattgcaactcctggtcaagcccccaactccagagctctctgccggagccccatgacaggcccctggccctgcctctgtctgactcccagattcagtggttctaccaggccctgaacctctccctgcccctccccaatttccatgctgggacggagcctgatggcctggaccccatggtcacactgtccctgaacctgggcttgtcttttgctgagctgcgccgcatgtacttgttcctcaatagttcaggacttttggttcttccccaggctggactcttgacacctcacccttcctgaattccacagtgcaaatatctttctgtaacaccctcagcatcctgcac

SEQ ID NO: 124866 - DNA, 807 bp, Homo sapiens; identical to SEQ ID NO: 124853
  Payload ID: 4519
  Gene Symbol:
  Gene Name: DAMA-236L13.20
  ENST ID: ENST00000451335
  CDS Start-End: 1-639

SEQ ID NO: 124867 - DNA, 1255 bp, Homo sapiens; identical to SEQ ID NO: 114624
  Payload ID: 4519
  Gene Symbol:
  Gene Name: DAMA-236L13.20
  ENST ID: ENST00000622393
  CDS Start-End: 341-1255

SEQ ID NO: 124868 - DNA, 1181 bp, Homo sapiens; identical to SEQ ID NO: 114625
  Payload ID: 4519
  Gene Symbol:
  Gene Name: DAMA-236L13.20
  ENST ID: ENST00000620322
  CDS Start-End: 13-699

SEQ ID NO: 124869 - DNA, 826 bp, Homo sapiens; identical to SEQ ID NO: 114619
  Payload ID: 4519
  Gene Symbol:
  Gene Name: DAMA-236L13.20
  ENST ID: ENST00000611721
  CDS Start-End: 341-826

SEQ ID NO: 124870 - DNA, 4506 bp, Homo sapiens
  Payload ID: 4520
  Gene Symbol: DDB1
  Gene Name: damage-specific DNA binding protein 1, 127kDa
  Uniprot ID: Q16531
  ENST ID: ENST00000301764
  CDS Start-End: 399-3821
gggagtctgcgggcgagctcggaggacactggcgcacctcccccgccggctcacggccgcatccgccacatccgaaggcgccgcgacttcccggagaccccgaagcgtgcgctctcatccgggtcctgcgggcgctggcggaaagaggcgaggcggtgcctccgggggcggggcctccttcggttggcggcctcgggcttcgggagtcctccaagaggccaggtgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttggccatgggaggcctttccctaagccagctgcccccagagccacagttcccctatgtggaagtggggcgggcttcatagagacttgggaatgagctgaaggtgaaacattttctccctggatttttaccagtctcacatgattccagccatcaccttagaccaccaagccttgattggtgttgccagttgtcctccttccggggaaggattttgcagttctttggctgaaaggaagctgtgcgtgtgtgtgtgtgtatgtgtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagcctgggtgtaaaacctggagatggtggatgatccccacgccacagcccttttgtctctgcaaactgccttcttcggaaagaagaaggtgggaggatgtgaattgttagtttctgagttttaccaaataaagtagaatataagaagaaa

SEQ ID NO: 124871 - DNA, 3906 bp, Homo sapiens
  Payload ID: 4520
  Gene Symbol: DDB1
  Gene Name: damage-specific DNA binding protein 1, 127kDa
  ENST ID: ENST00000540166
  CDS Start-End: 395-3673
acaatctcatcggcggttgccatctgtcagagggagccaggaatgagctgcatctggggggccttggccttagggcggcctgtgccagagggaccacctacctttatccggcgcacaccagcttccccgtggatccctgcggatagatgtggtcactgctgacccactcaaggcctggggatttgctcatcgtttttatcaaggactcacacagtgctggactcacacaagccagaagagggtttagggaccagtgctatccctggtttcagtggcctgaaaggatggaaaaggaaaggaagtcaagtgaggcctccaggactctgcttgatcaacaccacacaaccactggagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcagtcccagagccctttgggggggccatcatcattggacaggagtcaatcacctatcacaatggtgacaaatacctggctattgcccctcctatcatcaagcaaagcacgattgtgtgccacaatcgagtggaccctaatggctcaagatacctgctgggagacatggaaggccggctcttcatgctgcttttggagaaggaggaacagatggatggcaccgtcactctcaaggatctccgtgtagaactccttggagagacctctattgctgagtgcttgacataccttgataatggtgttgtgtttgtcgggtctcgcctgggtgactcccagcttgtgaagctcaacgttgacagtaatgaacaaggctcctatgtagtggccatggaaacctttaccaacttaggacccattgtcgatatgtgcgtggtggacctggagaggcaggggcaggggcagctggtcacttgctctggggctttcaaggaaggttctttgcggatcatccggaatggaattggaatccacgagcatgccagcattgacttaccaggcatcaaaggattatggccactgcggtctgaccctaatcgtgagactgatgacactttggtgctctcttttgtgggccagacaagagttctcatgttaaatggagaggaggtagaagaaaccgaactgatgggtttcgtggatgatcagcagactttcttctgtggcaacgtggctcatcagcagcttatccagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggagagatcattcctcgctccatcctgatgaccacctttgagagtagccattacctcctttgtgccttgggagatggagcgcttttctactttgggctcaacattgagacaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctatcctgacagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttccacctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattagccaagggcagggggcccctttgctgaccctccccaaaggctttgccctgctgccctccccctcctctccaccatcgtcttcttgg

SEQ ID NO: 124872 - DNA, 540 bp, Homo sapiens
  Payload ID: 4520
  Gene Symbol: DDB1
  Gene Name: damage-specific DNA binding protein 1, 127kDa
  ENST ID: ENST00000543627
  CDS Start-End: 213-540
ctggaggctgcagggctgacggctctcctggctcattaaggttccctacggagaaatactggttttgtgtttgaggttcgaatttgtagagcaataggggcactaataacgttgggcaagcagaccggtgggccctttgaagtctgaagaatcaacgcgcaaaagggaggagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccagg

SEQ ID NO: 124873 - DNA, 1220 bp, Homo sapiens
  Payload ID: 4520
  Gene Symbol: DDB1
  Gene Name: damage-specific DNA binding protein 1, 127kDa
  ENST ID: ENST00000535283
  CDS Start-End: 803-1220
gcctggcccagtgctgggtttgccttgttgacgatgcgcttggattgttaaggacaccgatgttcagaacccgggaagagtcatcttaacccacattctcagctgaatatgcagaccccaagcttgcatgtttatatacaccctaatcatgattccaaaacaaaactgttgttcagagttggaggtagctgagtgtggatggaggtattggtagactgccaggagggcagggggtgtggacaaaacagtgttttcatataaagctctgggacttcttcatttgacttggtctgtcagataaaagttttgtgagactttagatgaagactggaagaagtgaacactttctccggcattctcaattagagcctgccactgtaactgtaatagagtaaaattggaggggcaagaggcatgagaagggattacgcagtcattgtcatttggaggacacacggctcttaggtccagtccagttttcttagtctgattagggaagtagctttgttgaatgcatgaactgagactctttgaggtgccggatttggcaagaaggggagtagctggagggagttggagaagtatgtgaagtaaatgagaattctggaggtatttagacataagtgataggattattttgaagggatgggaggcccttcccctgagttcaaaagttagagggtctgttctttcaggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggtactggatcaggaagagagagcgagaaactgtgagg

SEQ ID NO: 124874 - DNA, 558 bp, Homo sapiens
  Payload ID: 4520
  Gene Symbol: DDB1
  Gene Name: damage-specific DNA binding protein 1, 127kDa
  ENST ID: ENST00000542337
  CDS Start-End: 121-558
aagaggcgaggcggtgcctccgggggcggggcctccttcggttggcggcctcgggcttcgggagtcctccaagaggccagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagat

SEQ ID NO: 124875 - DNA, 805 bp, Homo sapiens
  Payload ID: 4520
  Gene Symbol: DDB1
  Gene Name: damage-specific DNA binding protein 1, 127kDa
  ENST ID: ENST00000539426
  CDS Start-End: 310-805
gccccgggggcggccgggcaggagtgggcccggcgaatggaaggcgctggcggccgaggaacctcccccagcaccgcgacctcgaaagagtcgtccctgtacgcgctttttgggggttggaagccgctctcgagggtcccctttcgtcctggggaggtcattcggcctcgagaacagggcgggcccagtgagacagaggagtgacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaagggggagagcaaggacctgctgtttatcttgacagcgaagtacaatgcctgcatcctggagtataaacagagtggcgagagcattgacatcattacgcgagcccatggcaatgtccaggaccgcattggccgcccctcagagaccggcattattggcatcattgaccctgagtgccggatgattggcctgcgtctctatgatggccttttcaaggttattccactagatcgcgataataaagaactcaaggccttcaacatccgcctggaggagctgcatgtcattgatgtcaagttcctatatggttgccaagcacctactatttgctttgtctaccaggaccctcaggggcggcacgtaaaaacctatgaggtgtctctccgagaaaaggaattcaataagggcccttggaaacaggaaaatgtcgaagctgaagcttccatggtgatcgcag

SEQ ID NO: 124876 - DNA, 571 bp, Homo sapiens
  Payload ID: 4520
  Gene Symbol: DDB1
  Gene Name: damage-specific DNA binding protein 1, 127kDa
  ENST ID: ENST00000543658
  CDS Start-End: 86-571
gctgttgggggccacctgtcttttcgcttgtgtccctctttctagtgtcgcgctcgagtcccgacgggccgctccaagcctcgacatgtcgtacaactacgtggtaacggcccagaagcccaccgccgtgaacggctgcgtgaccggacactttacttcggccgaagacttaaacctgttgattgccaaaaacacgagattagagatctatgtggtcaccgccgaggggcttcggcccgtcaaagaggtgggcatgtatgggaagattgcggtcatggagcttttcaggcccaaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtcttt

SEQ ID NO: 124877 - DNA, 1870 bp, Homo sapiens
  Payload ID: 4521
  Gene Symbol: DDB2
  Gene Name: damage-specific DNA binding protein 2, 48kDa
  Uniprot ID: Q92466
  ENST ID: ENST00000256996
  CDS Start-End: 196-1479
ctccgagacgggtggggccggagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgatatggccaataaaaccataccgactgagcttctgcgtggatcttccagaa

SEQ ID NO: 124878 - DNA, 717 bp, Homo sapiens
  Payload ID: 4521
  Gene Symbol: DDB2
  Gene Name: damage-specific DNA binding protein 2, 48kDa
  Uniprot ID: Q92466
  ENST ID: ENST00000378600
  CDS Start-End: 1-717
atggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaaggggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtga

SEQ ID NO: 124879 - DNA, 1591 bp, Homo sapiens
  Payload ID: 4521
  Gene Symbol: DDB2
  Gene Name: damage-specific DNA binding protein 2, 48kDa
  Uniprot ID: Q92466
  ENST ID: ENST00000378601
  CDS Start-End: 146-880
gcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttg

SEQ ID NO: 124880 - DNA, 1092 bp, Homo sapiens
  Payload ID: 4521
  Gene Symbol: DDB2
  Gene Name: damage-specific DNA binding protein 2, 48kDa
  Uniprot ID: Q92466
  ENST ID: ENST00000378603
  CDS Start-End: 1-1092
atggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcagattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtga

SEQ ID NO: 124881 - DNA, 793 bp, Homo sapiens
  Payload ID: 4521
  Gene Symbol: DDB2
  Gene Name: damage-specific DNA binding protein 2, 48kDa
  ENST ID: ENST00000610805
  CDS Start-End: 50-325
ctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccgaccacacagacatggaaaggccgcaggaggtgatgagacagagattaaccgtgccgaatgaaacaaggcttcctttcggggaattcagcagaaaaacctttcgtgagattggagaggaaaatatgtctgttctgcttggcaggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaa

SEQ ID NO: 124882 - DNA, 960 bp, Homo sapiens
  Payload ID: 4521
  Gene Symbol: DDB2
  Gene Name: damage-specific DNA binding protein 2, 48kDa
  Uniprot ID: Q92466
  ENST ID: ENST00000616278
  CDS Start-End: 1-471
atggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggcatctggttttgtagcctggatgtgtctgctagtagccgaatggtggtcacaggagacaacgtggggaacgtgatcctgctgaacatggacggcaaagagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtga

SEQ ID NO: 124883 - DNA, 556 bp, Homo sapiens
  Payload ID: 4521
  Gene Symbol: DDB2
  Gene Name: damage-specific DNA binding protein 2, 48kDa
  ENST ID: ENST00000622878
  CDS Start-End: 277-556
acccgcagaggcctggcagcgccgcgtttgaggagggttcgtgtcaggaagtcaaggctggatgatcgcttaagcccaggagttaaagaccggcccggacaacaaagcgagaccccgtctctccagaaaaagaaaaaaagagagagagagagagaaattagccgggcgtggtggcgtacgcttgtagtcccatctacttaggaggctgagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcct

SEQ ID NO: 124884 - DNA, 580 bp, Homo sapiens
  Payload ID: 4521
  Gene Symbol: DDB2
  Gene Name: damage-specific DNA binding protein 2, 48kDa
  ENST ID: ENST00000622090
  CDS Start-End: 93-580
gtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtactgcctgtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcac

SEQ ID NO: 124885 - DNA, 1649 bp, Homo sapiens
  Payload ID: 4521
  Gene Symbol: DDB2
  Gene Name: damage-specific DNA binding protein 2, 48kDa
  ENST ID: ENST00000617847
  CDS Start-End: 1-287
ctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaaataagccagcatggcgtggacccagaaagccacctagagaatggagcaacagctcagaacttgagactgaatgccctgcactcactgtggtgtaatgacctgacctgttcctgggtggaagcttatatggatggaatcttttccataaagtgctctggacttcccaagagaaagtggctggagaaattacagaatgcggccgggtgcagtggctcatgcttgaaatcccagcactttgggaggccaagcatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaagtagggacggggtttcaccatgttagccaggatggtctcgatctcctgacctcgtgatccgcctgcctcagcctcccaaagtgttgagattacaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggcgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcacttttgat

SEQ ID NO: 124886 - DNA, 852 bp, Homo sapiens
  Payload ID: 4521
  Gene Symbol: DDB2
  Gene Name: damage-specific DNA binding protein 2, 48kDa
  ENST ID: ENST00000614825
  CDS Start-End: 170-852
agcgagaccccgtctctccagaaaaagaaaaaaagagagagagagagagaaattagccgggcgtggtggcgtacgcttgtagtcccatctacttaggaggctgaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgct

SEQ ID NO: 124887 - DNA, 1433 bp, Homo sapiens
  Payload ID: 4522
  Gene Symbol: DAOA
  Gene Name: D-amino acid oxidase activator
  Uniprot ID: P59103
  ENST ID: ENST00000329625
  CDS Start-End: 279-527
ttagctgggaggacccaaaatgctggaaaagctgatgggtgctgattctctccagcttttcagggtataaaggaatctgaacacgactgatattttctttaatttttagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtaatatgttttataaaattatatttttatgaatatttttatgaaatataatttttatgaattatatttttatgaagatttgttacacaatgatataaactaataccataggtaatcaaaatcctctcctcttgtttggtaatatttcatcactaaattattattgaaagttacacatactgctttgtgagctgtcataatcagtaaaacaaacaacggaaattcaaaagtcctgtgaagttttttgaatagttagtgaatttatgtgggaaaatattcaagtatattaatttatccaaatagtaatgatgtctccctttgccattgttatggatttatggatttatgtatctgatacatgtaacattacattttcaatcaatactattgatggacccttccctacttttataatttctaactatagttttagggagaatactaataatggaagcattacttttattttttctataaattcctctggaaatatgtatttcttatgtcctaaggttattaacaaaaagagaaaataatttctgatttataattcactttccttcaaaaaataataactcagtgtctagtaaggtaaagcaaaaaaagttaaaagaacccataagtttattttaaaatacctactcagaagcaaaactgactttctattaaaaattaaaaaaaaaagttttcttattattgttttgtttccttgtttttaggtgatgggattgtatttgcaactctctggtcagtaagtgataaaatgccatttctatgcacccacctggcctgtgt

SEQ ID NO: 124888 - DNA, 742 bp, Homo sapiens
  Payload ID: 4522
  Gene Symbol: DAOA
  Gene Name: D-amino acid oxidase activator
  Uniprot ID: P59103
  ENST ID: ENST00000375936
  CDS Start-End: 47-508
tcatctctgcttcacaatgccgatgatttagctgggaggacccaaaatgctggaaaagctgatgggtgctgattctctccagcttttcagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgtgactgggagaatctctctttttattaaatgtgcttcaagttttaaca

SEQ ID NO: 124889 - DNA, 1009 bp, Homo sapiens
  Payload ID: 4522
  Gene Symbol: DAOA
  Gene Name: D-amino acid oxidase activator
  Uniprot ID: P59103
  ENST ID: ENST00000559369
  CDS Start-End: 527-775
ccaaacttctttcatttaaagaaccaaacttctttaaataaaaatgactcacaataatttaatattttaccatttacaaagagattaactacaacaatattgatcttgagttaatttcccacgaataacattttcatttcttaaaatttgctgaatggaaagccagaaagtagagtgaagcaagtaatgtgtgtgatttggaaagggcatggcaggaggtctcatctctgcttcacaatgccgatgatttagctgggaggacccaaaatgctggaaaagctgatgggtgctgattctctccagcttttcagggtataaaggaatctgaacacgactgatattttctttaatttttagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgtgactgggagaatctctctttttattaaatgtgcttcaagttttaaca

SEQ ID NO: 124890 - DNA, 823 bp, Homo sapiens
  Payload ID: 4522
  Gene Symbol: DAOA
  Gene Name: D-amino acid oxidase activator
  ENST ID: ENST00000595812
  CDS Start-End: 259-636
ttagctgggaggacccaaaatgctggaaaagctgatgggtgctgattctctccagcttttcagggtataaaggaatctgaacacgactgatattttctttaatttttagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagagctgggacttctaaccaatggaacatgggaaaggtgatgacacttgactccggtgatgaggttacctttcacaagacctggccaactgagaccggatctccttacaggcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgt

SEQ ID NO: 124891 - DNA, 1027 bp, Homo sapiens
  Payload ID: 4522
  Gene Symbol: DAOA
  Gene Name: D-amino acid oxidase activator
  Uniprot ID: P59103
  ENST ID: ENST00000473269
  CDS Start-End: 272-652
tgaatggaaagccagaaagtagagtgaagcaagtaatgtgtgtgtgagtagtcattggatacatacataacagtgagcaagtttatcagctcctgcatggcagtgttctgatgatcttttgctgcaaaagagctacaccccaaattagtggcttaaagtaaaagcttactagtgtatatgatgattctgttggtccaggatttggaaagggcatggcaggaggtctcatctctgcttcacaatgccgatgatttagctgggaggacccaaaatgctggaaaagctgatgggtgctgattctctccagcttttcagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagaacattccaaggtgattctaaatggcaatttgcactgtcattttaaaagaatttctcagatatttgctgggcactttatggaaggagacactgaggcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgtgactgggagaatc

SEQ ID NO: 124892 - DNA, 921 bp, Homo sapiens
  Payload ID: 4522
  Gene Symbol: DAOA
  Gene Name: D-amino acid oxidase activator
  ENST ID: ENST00000488534
  CDS Start-End: 349-516
agcaagtaatgtgtgtgatttggaaagggcatggcaggaggtctcatctctgcttcacaatgccgatgatttagctgggaggacccaaaatgctggaaaagctgatgggtgctgattctctccagcttttcagggtataaaggaatctgaacacgactgatattttctttaatttttagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagaacattccaaggtgattctaaatggcaatttgcactgtcattttaaaagaatttctcagatatttgctgggcactttatggaaggagacactgaggcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgtgactgggagaatctctctttttattaaatgtgcttcaagtttt

SEQ ID NO: 124893 - DNA, 777 bp, Homo sapiens
  Payload ID: 4522
  Gene Symbol: DAOA
  Gene Name: D-amino acid oxidase activator
  ENST ID: ENST00000601240
  CDS Start-End: 20-316
ttagctgggaggacccaaaatgctggaaaagctgatgggtgctgattctctccagcttttcagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagagctgggacttctaaccaatggaacatgggaaaggtgatgacacttgactccggtgatgaggttacctttcacaagacctggccaactgagaccggatctccttacaggcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgt

SEQ ID NO: 124894 - DNA, 982 bp, Homo sapiens
  Payload ID: 4522
  Gene Symbol: DAOA
  Gene Name: D-amino acid oxidase activator
  Uniprot ID: P59103
  ENST ID: ENST00000600388
  CDS Start-End: 534-782
tgctgaatggaaagccagaaagtagagtgaagcaagtaatgtgtgtgtgagtagtcattggatacatacataacagtgagcaagtttatcagctcctgcatggcagtgttctgatgatcttttgctgcaaaagagctacaccccaaattagtggcttaaagtaaaagcttactagtgtatatgatgattctgttggtccaggatttggaaagggcatggcaggaggtctcatctctgcttcacaatgccgatgatttagctgggaggacccaaaatgctggaaaagctgatgggtgctgattctctccagcttttcagggtataaaggaatctgaacacgactgatattttctttaatttttagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgtgactgggagaatc

SEQ ID NO: 124895 - DNA, 681 bp, Homo sapiens
  Payload ID: 4522
  Gene Symbol: DAOA
  Gene Name: D-amino acid oxidase activator
  ENST ID: ENST00000489237
  CDS Start-End: 42-233
tctgcttcacaatgccgatgatttagctgggaggacccaaaatgctggaaaagctgatgggtgctgattctctccagcttttcagatccagatatacattgggtaaaatctacttcataggttttcaaaggagcattcttctgagcaaatctgaaaactctctaaactctattggagacagaagaaggaagagagacggtaacaaggaaagaaggatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcct

SEQ ID NO: 124896 - DNA, 973 bp, Homo sapiens
  Payload ID: 4522
  Gene Symbol: DAOA
  Gene Name: D-amino acid oxidase activator
  ENST ID: ENST00000471432
  CDS Start-End: 1-92
tgagcaaatctgaaaactctctaaactctattgggtctcactatgttgcccaggctggagtgcagcagcgcctcggcctccccaagtgctaggattacaggtgtcagccacaacacccagcccattaatgtttaatcccctagaagcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagaacattccaaggtgattctaaatggcaatttgcactgtcattttaaaagaatttctcagatatttgctgggcactttatggaaggagacactgagctcattttgtataaagcaggcctttatgtcagaagctgagacctccaacagatggaaatgaaaaccatcctgctaccagaccttggatctggaaggagctgggacttctaaccaatggaacatgggaaaggtgatgacacttgactccggtgatgaggttacctttcacaagacctggccaactgagaccggatctccttacaggcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtgatgggattgtatttgcaactctctggtcagtaagtgataaaatgccatttctatgcacccacctggcctgtgtgactgggagaatc

SEQ ID NO: 124897 - DNA, 1368 bp, Homo sapiens
  Payload ID: 4522
  Gene Symbol: DAOA
  Gene Name: D-amino acid oxidase activator
  Uniprot ID: P59103
  ENST ID: ENST00000618629
  CDS Start-End: 1-462
atgctggaaaagctgatgggtgctgattctctccagcttttcagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaaatggcacagaggcatttacagagatcattatgtccttgggtctcttaccttcctcagccctatgcagagcttgaagaagtaagcagccatgttggaaaagtcttcatggcaagaaactatgagttccttgcctatgaggcctctaaggaccgcaggcagcctctagaacgaatgtggacctgcaactacaaccagcaaaaagaccagtcatgcaaccacaaggaaataacttctaccaaagctgaatgagtttggaagcagattcttcccagccaatccttctgatgacaatgtagtctggccaacatcttcactggactctgacggactctgtgtctgggacccagctgataacacgtggtaatatgttttataaaattatatttttatgaatatttttatgaaatataatttttatgaattatatttttatgaagatttgttacacaatgatataaactaataccataggtaatcaaaatcctctcctcttgtttggtaatatttcatcactaaattattattgaaagttacacatactgctttgtgagctgtcataatcagtaaaacaaacaacggaaattcaaaagtcctgtgaagttttttgaatagttagtgaatttatgtgggaaaatattcaagtatattaatttatccaaatagtaatgatgtctccctttgccattgttatggatttatggatttatgtatctgatacatgtaacattacattttcaatcaatactattgatggacccttccctacttttataatttctaactatagttttagggagaatactaataatggaagcattacttttattttttctataaattcctctggaaatatgtatttcttatgtcctaaggttattaacaaaaagagaaaataatttctgatttataattcactttccttcaaaaaataataactcagtgtctagtaaggtaaagcaaaaaaagttaaaagaacccataagtttattttaaaatacctactcagaagcaaaactgactttctattaaaaattaaaaaaaaaagttttcttattattgttttgtttccttgtttttaggtgatgggattgtatttgcaactctctggtcagtaagtgataaaatgccatttctatgcacccacctggcctgtgt

SEQ ID NO: 124898 - DNA, 1756 bp, Homo sapiens
  Payload ID: 4523
  Gene Symbol: DAO
  Gene Name: D-amino-acid oxidase
  Uniprot ID: P14920
  ENST ID: ENST00000228476
  CDS Start-End: 205-1248
agtgcagtgccgagccccacccctcaagccgtgccctgtccatagctccagactttgaccctgcactccagtccgggctggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaacaga

SEQ ID NO: 124899 - DNA, 1345 bp, Homo sapiens
  Payload ID: 4523
  Gene Symbol: DAO
  Gene Name: D-amino-acid oxidase
  ENST ID: ENST00000551281
  CDS Start-End: 114-959
gaaacccacgcagcctcctggattcttccccgtccctccctctgtcctggggctgtgacctcctccatgttattcacagggtctcagcacgattcatctcaaaggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgca

SEQ ID NO: 124900 - DNA, 640 bp, Homo sapiens
  Payload ID: 4523
  Gene Symbol: DAO
  Gene Name: D-amino-acid oxidase
  ENST ID: ENST00000547166
  CDS Start-End: 51-640
gagagatccagcctctcaaacatccagcagagagaccataggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagcc

SEQ ID NO: 124901 - DNA, 1576 bp, Homo sapiens
  Payload ID: 4523
  Gene Symbol: DAO
  Gene Name: D-amino-acid oxidase
  ENST ID: ENST00000547122
  CDS Start-End: 144-380
tgcactccagtccgggctggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcgacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaactatctgatgttgtttaacccagtgcttgctaaacctatctggctatggaactcttttgcccagagcacccatgaatgccatgacacaaatctgagaaaatgctggaa

SEQ ID NO: 124902 - DNA, 2385 bp, Homo sapiens
  Payload ID: 4523
  Gene Symbol: DAO
  Gene Name: D-amino-acid oxidase
  ENST ID: ENST00000549215
  CDS Start-End: 95-466
agaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactggacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccgctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtatgctcccatggcaaggaaagtaatgccctcttccactcctcagatggctctggcattttcagggaacagtcatgtctgatctcaagttccacacaggctccatagcaggcaggggcagtggtggctaatatcccctcctctataaatggggaaactgaggctcaatgatggttaaggacctgctcaaggttacatagaggggcagtggtgatgttaatggaggtggtgctgatgagatcaatgttgataatggtgtgactgggagtggggatggtagctggtgctgatggaaatgacactatcaagtatgttagtaccacagcagaggtgacgatctcaaaggcagtgttaacatggctgcactaactgtctcattggcaatattaatcgtgtggcagagatgacagtatcaatggcagtgttaatgatggtggtgaaatggtgaatggggttggttttctaaagtctgtggtcaaataacaggaaaatgtgtacttactggatgtgtacttcgtgtcagacacagcagcaagtccattacatgaatgaccttattaaatctcctctggagctctttgggatagggacagttctccctatgcttcggatgaggaaactggggtgaattaagaggtgaagtcacttgcccaagtcagaccactggtggaaggcagggctgggatgtgatttgaatttgactccaaggctatttccagatatccattttgtggctgccccatcatctcttgcaactgttccagggggtccccaccattccaccccggtgccaagagaagctcaggtggcatctggctttgcccaggactcttcgggaggctcctgagtcttccagggcagaagagcttcatctattctttccactgtccctctcggacctggccaccttctctcttgcctctcctaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcagcaaagacaa

SEQ ID NO: 124903 - DNA, 676 bp, Homo sapiens
  Payload ID: 4523
  Gene Symbol: DAO
  Gene Name: D-amino-acid oxidase
  ENST ID: ENST00000547768
  CDS Start-End: 177-676
ggcggacagagggctggaaacaagacgctccagaatcaggagcttcccctcaggaaatagcatcctgtgtccccgcactgcagttgtctggtctctccagcagtttggtacttccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcg

SEQ ID NO: 124904 - DNA, 1877 bp, Homo sapiens
  Payload ID: 4524
  Gene Symbol: DAND5
  Gene Name: DAN domain family member 5, BMP antagonist
  Uniprot ID: Q8N907
  ENST ID: ENST00000317060
  CDS Start-End: 180-749
actctcctcccccgctgtgggtctacagaaatgcctcccaggctatccaggaggggccaagagattaaaagcaggttcagaaggctcagatgccactcaccagacagcagggtcgactgctagtgaccttgagcccagtccggacagacagacaggcagacagacgcacggacaagcagatgctccttggccagctatccactcttctgtgcctgcttagcggggccctgcctacaggctcagggaggcctgaaccccagtctcctcgacctcagtcctgggctgcagccaatcagacctgggctctgggcccaggggccctgcccccactggtgccagcttctgcccttgggagctggaaggccttcttgggcctgcagaaagccaggcagctggggatgggcaggctgcagcgtgggcaagacgaggtggctgctgtgactctgccgctgaaccctcaggaagtgatccaggggatgtgtaaggctgtgcccttcgttcaggtgttctcccggcccggctgctcagccatacgcctccgaaatcatctgtgctttggtcattgctcctctctctacatccctggctcggaccccaccccactagtcctgtgcaacagctgtatgcctgctcgcaagcgttgggcacccgtggtcctgtggtgtctcactggcagctcagcctcccgtcgacgggtgaagatatccaccatgctgatcgaggggtgtcactgcagcccaaaagcatgaactgagcatcgtggatgggtgcacggagacacgcaccttggagaaatgaggggagatggaccaagaaagacgtggacctggatgatgtactctgggtcaagagaccagggatgcagggttaggcagacaggtccccagagtcctcaccctgctccccagacagtagacacagtgcccgtcctggagttgcaccactgatagtcacagcacacaatgattgacaactcactttttttttttttttttgagatggagtctcgctctgtcgcccaggctggagtgcagtggcgcaatctcagctcactgcaagctccacctcccgggtttatgccattctcctgtctcagcctcccgagtagctgggactacaggcacccgccaacacgcccggctaattttttgtatttttagtaaagacagggtttcaccgtgttagccaggatggtctctatctcctgacctcgtgatctgcctgccttggccttattattttttttttttaaggacagagtctctctctgtcacccaggctggagtgcaatggcgcgatcttggctcactgtaacttccacttgccaggctcaagcagttctcctgcctcagcctcctgagtagctgggactacaggcacccgccaccatgcccagctaatttttgtatttttagtagagacagagtttcaccatattagcctggctggtctcaaactcctggcctcaggtgatctgcccacctcggcctcccaaagtgctgggatcaaatccactgttaatcattaggctgaactgtctcttatagaatgaggtcaaagacactcccagttgcagggagggtagatggccccacccagaccgagagacacagtgatgacctcagcctagggacaccaaaaaagaaaaaaaaaaaaacccaaaccaaaaacgcaaaccaaagcaggcaggcagacagctgctgggggaaatcctggggtccttgagacagaggcaggaccctcgtgttcccagctgcctcttgccttgatagtggtgctgtgtccctctcagaccccccacctgagtctccacagagccccacgcctggcatggcattccacagaaaccataaaggttggctgagtccagctgtcta

SEQ ID NO: 124905 - DNA, 1731 bp, Homo sapiens
  Payload ID: 4524
  Gene Symbol: DAND5
  Gene Name: DAN domain family member 5, BMP antagonist
  ENST ID: ENST00000585548
  CDS Start-End: 97-588
gggagacctggaaggaagcgactgcactgatccagaaatgcctcccaggctatccaggaggggccaagagattaaaagcaggttcagaaggctcagatgccactcaccagacagcagggtcgactgctagtgaccttgagcccagtccggacagacagacaggcagacagacgcacggacaagcagatgctccttggccagctatccactcttctgtgcctgcttagcggggccctgcctacaggctcagggaggcctgaaccccagtctcctcgacctcagtcctgggctgcagccaatcagacctgggctctgggcccaggggccctgcccccactggtgccagcttctgcccttgggagctggaaggccttcttgggcctgcagaaagccaggcagctggggatgggcaggctgcagcgtgggcaagacgaggtggctgctgtgactctgccgctgaaccctcaggaagtgatccaggggatgtgtaaggctgtgcccttcgttcagacacgggagtctcgctatgttgcccaagctagtcttgagcttctggcctcaagcaatcctcccacctcagcctcctgagttctaggtgttctcccggcccggctgctcagccatacgcctccgaaatcatctgtgctttggtcattgctcctctctctacatccctggctcggaccccaccccactagtcctgtgcaacagctgtatgcctgctcgcaagcgttgggcacccgtggtcctgtggtgtctcactggcagctcagcctcccgtcgacgggtgaagatatccaccatgctgatcgaggggtgtcactgcagcccaaaagcatgaactgagcatcgtggatgggtgcacggagacacgcaccttggagaaatgaggggagatggaccaagaaagacgtggacctggatgatgtactctgggtcaagagaccagggatgcagggttaggcagacaggtccccagagtcctcaccctgctccccagacagtagacacagtgcccgtcctggagttgcaccactgatagtcacagcacacaatgattgacaactcactttttttttttttttttgagatggagtctcgctctgtcgcccaggctggagtgcagtggcgcaatctcagctcactgcaagctccacctcccgggtttatgccattctcctgtctcagcctcccgagtagctgggactacaggcacccgccaacacgcccggctaattttttgtatttttagtaaagacagggtttcaccgtgttagccaggatggtctctatctcctgacctcgtgatctgcctgccttggccttattattttttttttttaaggacagagtctctctctgtcacccaggctggagtgcaatggcgcgatcttggctcactgtaacttccacttgccaggctcaagcagttctcctgcctcagcctcctgagtagctgggactacaggcacccgccaccatgcccagctaatttttgtatttttagtagagacagagtttcaccatattagcctggctggtctcaaactcctggcctcaggtgatctgcccacctcggcctcccaaagtgctgggatcaaatccactgttaatcattaggctgaactgtctcttatagaatgaggtcaaagacactcccagttgcagggagggtagatggccccacccagaccgagagacacagtgatgacctcagcctagggacaccaa

SEQ ID NO: 124906 - DNA, 2878 bp, Homo sapiens
  Payload ID: 4525
  Gene Symbol:
  Gene Name: DAQB-143M3.10
  ENST ID: ENST00000464460
  CDS Start-End: 569-1474
ggaagtggggagaatcaaggcggggaaatcggacttttgggtcgctgggggcaacgaagcctggagaggccttctttccattcccagaatatgtttgctgctttttcctctccccactggcctaaatggatcgctccgcctgtttcctccccagcacctagggcgcaatggaatattccattgcccctcctgtcctgggtctgtgttgcggggaacgctcgcgcggttgccagagaaagccccggacgtgacggatttgcgcgaccccaagcagcccgcccttccccctcccatccgtcattcccctgcgctctctttcctcacccttccccccgccaccgtgggttccagacttgggataagtaaacagcgggtggagcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaacggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 124907 - DNA, 1010 bp, Homo sapiens
  Payload ID: 4525
  Gene Symbol:
  Gene Name: DAQB-143M3.10
  ENST ID: ENST00000486292
  CDS Start-End: 1-383
accacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagaggtgacaacagagggggtagggcccggggtgagctcttctcaggagccttctgctgggggtggggcttcacaggaggcaaaacataactgtaagtttagaatgggggtgagaggctgtcatctggagggagagcggggggcctcagtagcctcttgagggaagtgggactcctggctccccagggcctggcctactcaatctctcccacctcatcctctggcatggacgcagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgg

SEQ ID NO: 124908 - DNA, 4181 bp, Homo sapiens
  Payload ID: 4525
  Gene Symbol:
  Gene Name: DAQB-143M3.10
  ENST ID: ENST00000459812
  CDS Start-End: 192-1097
agcgaggcctacggacccaggccaggtgggagtctgcactcttcaaggggcctgggctgctgctcacgggtattaaagaactccgcgttgttcatggctgaggcgatgcattaggaagatcctggacctagagaacaagtcccccgaacgctgagttggaggcgggacttcgggtgcgcgttggcgggagcatgctggggctctgggggcagcggctccccgcggcgtgggtcctgcttctgttgcctttcctgccgctgctgctgcttgcagcccccgcgccccaccgcgcgtcctacaagccggtcatcgtggtgcatgggctcttcgacagctcgtacagcttccgccacctgctggaatacatcaatgagacacaccccgggactgtggtgacagtgctcgatctcttcgatgggagagagagcttgcgacccctgtgggaacaggtgcaagggttccgagaggctgtggtccccatcatggcaaaggcccctcaaggggtgcatctcatctgctactcgcaggggggccttgtgtgccgggctctgctttctgtcatggatgatcacaacgtggattctttcatctccctctcctctccacagatgggacagtatggagacacggactacttgaagtggctgttccccacctccatgcggtctaacctctatcggatctgctatagcccctggggccaggaattctccatctgcaactactggcatgatccccaccacgatgacttgtacctcaatgccagcagcttcctggccctgatcaatggggaaagagaccatcccaatgccacagtatggcggaagaactttctgcgtgtgggccacctggtgctgattgggggccctgatgatggtgttattactccctggcagtccagcttctttggtttctatgatgcaaatgagaccgtcctggagatggaggagcaactgcctgccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaacggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaactgggtcccaccctctccttttgctcccagcctacctccccagttgtgggaacaggtctggagtgagaggcagggagtggctaatgccaccaggaagaaatgaaaactggctcagagagggggaagcctcaacagaaaaagaaataaattaaaagccctcctatcccctccagccagggttcgttcctttccccaactccccagggggcagaagtgagtgcagcacctgatgtctgcttcttccccttgtgtctggcttcttcagatagtcaccaccaccccggccatcagtggagatttcccggaaaacagtgagcatggagtgccggactctgtcagccagagctgggacgtcatctggtgtcagcccttccgtgggcactgggggcagcacccgcacctgacattgtcctggggcaaggggagcaccatcatggcctgtccacccaggtctttgcccacagggatgtcctcccagcctctccggacacaccctaccccagaactgctcaaagccctcacccgaggtgaagcgacgctccttcttgcagtagaagtcttggatgactcacgtcctgggtgagcagggtctgggcgacctcagacatgacactgatggcatcccccgtgcgcttccggtcgatgaagatgactcctgccagccagcaggccagcccggcagagccagcccacagtagctcgcgcttggcaatgggcacacagcggcctggcagtacctccatcatcccttgggcagggtgggagtgggtgaggatcggggtggaggcagagtgtcacagaaggcaacccacctcacccagctcatcaccctctggtagggactggaggtgaaggaggagactaggcagggaggggggccccaagtgaaggaaagggtgaccaaaagtatatgtaccctgcttatgagggcagttctacccagggaatgaaggcctgagtgggaggcaagggggcaatgtcccagaggaaggggaattgaggatctctaggagaagatattctagggaaggtttcaggaggggaggcatggctgggggaggtgtgccctgtggtggggtctcaccaagcagatcgagagagctctggtggttggagacaacaacatagggctgcgagggagggaagtggtgagcccctcgcacctccactcggatcccgtacaggtatttgatgtggagcagcattagacgcaagatcctgtggggtcatggcaaggggtcccagtgggatccattgatgtccatctgcatgcctcagctccccccaccttactgtctttctgaccacctttgcagtcctctccccattccctgtctctggtctctctcagtcttttctacacacaccatgcccccttcccccaatccactactcactttgtacccttaggttccctcattgcccaagaccccttgcccctcacttcatgttctcgacgttgcgtcctcgcacggcacacacagggatggcgagcacagccaggaagaggatccagccattgtagaaggccatcttgaagaagtacttggcactggggctgcagaaccacagggtgggcagcaggaagagcagcagcaggaagagcagcagcagcagcatccatgcccctggccacaaatccattctggccacctgcaggggatggggcaagggacaatcagcctggtttctggaggagagtggggctccggatatattcagacaagagacacaagacacagacatctacaattcacagatacctgataataaatgacaacaagaataatagctaacacttgtagctggtaagggtcttataatggtctatacttgtgctgtccgagaaagtagccaccacctacatgtggctacttgaaatgcagctagtctgaactgagatgtgctggaaatgtaaaatacacatcagatttcaaagactgaataaaaaacaaaatgtg

SEQ ID NO: 124909 - DNA, 1101 bp, Homo sapiens
  Payload ID: 4526
  Gene Symbol:
  Gene Name: DAQB-331I12.15
  ENST ID: ENST00000519915
  CDS Start-End: 1-211
ccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccag

SEQ ID NO: 124910 - DNA, 1953 bp, Homo sapiens
  Payload ID: 4527
  Gene Symbol: DDO
  Gene Name: D-aspartate oxidase
  Uniprot ID: Q99489
  ENST ID: ENST00000368923
  CDS Start-End: 17-949
ctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcagggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtggcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaatttaacctg

SEQ ID NO: 124911 - DNA, 2130 bp, Homo sapiens
  Payload ID: 4527
  Gene Symbol: DDO
  Gene Name: D-aspartate oxidase
  Uniprot ID: Q99489
  ENST ID: ENST00000368924
  CDS Start-End: 17-1126
ctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagatacacccattcacacgcagaagcagtggttcagagaaacctttaatcacctctttgcaattgccaattctgcagaagctggagatgctggtgttcatttggtatcaggttggcagatatttcagagcactccgactgaagaagtgccattctgggctgacgtggttctgggatttcgaaagatgactgaggctgagctgaagaaattcccccagtatgtgtttggtcaggcttttacaaccctgaaatgtgaatgccctgcctacctcccgtggttggagaaaaggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtggcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaatttaacctg

SEQ ID NO: 124912 - DNA, 2021 bp, Homo sapiens
  Payload ID: 4527
  Gene Symbol: DDO
  Gene Name: D-aspartate oxidase
  ENST ID: ENST00000479373
  CDS Start-End: 17-349
ctctgtctctcagggcatgagaccagccaggcactgggaaacaaggtttggtgccagagattttggtggcttccaagactgctttttcagagacaggctcatggacacagcacggattgcagttgtcggggcaggtgtggtggggctctccacggctgtgtgcatctccaaactggtgccccgatgctccgttaccatcatttcagacaagtttactccagataccaccagtgatgtggcagccggaatgcttattcctcacacttatccagttggcagatatttcagagcactccgactgaagaagtgccattctgggctgacgtggttctgggatttcgaaagatgactgaggctgagctgaagaaattcccccagtatgtgtttggtcaggcttttacaaccctgaaatgtgaatgccctgcctacctcccgtggttggagaaaaggataaagggaagtggaggctggacactcactcggcgaatagaagacctgtgggaacttcatccgtcctttgacatcgtggtcaactgttcaggccttggaagcagacagcttgcaggagactcaaagattttccctgtaaggggccaagtcctccaagttcaggctccctgggtggagcattttatccgagatggcagtgggctgacatatatttatcctggtacatcccatgtaaccctaggtggaactaggcaaaaaggggactggaatctgtccccggatgcagaaaatagcagagagattctttcccgatgctgtgctctggagccctccctccacggagcctgcaacatcagggagaaggtgggcttgaggccctacaggccaggcgtgcgactgcagacagagctccttgcgcgagatggacagaggctgcctgtagtccaccactatggccatgggagtgggggcatctcagtgcactggggcactgctctggaggccgccaggctggtgagcgagtgtgtccatgccctcaggacccccattcccaagtcaaacctgtagatgacataaaatgacagcaaagagactgagagactgttgatcaaagcacagaacaggttcaaataacttttccactgcatgaaagtttaattagacatttctttgttttcaacattagaagtggtgtaacatgtaagctgagcacggtggcatgcctatagtcccagctacttgagaggctgaggcaggaggattgttgagcccaggagtttgagtgcaatctgggtaacattttttagaggtgccagttcccacctctaaaaaaaacaccaacaacaaaagaaatgatgcaacatgtaggcttacttaggaagtccagcattaatggcatagggcataaagctctattttttgttaaaaatacttcttatagagtaaaatttatttagaactgatgtccaaggacctatgcagatttatatgaatgttggaagctatagagattttgatatcatttggcttataaatccacaggaggagataatgtatggaaaacatttaaatcactgtcaattgcagagctgcctgtgatcttcttaggttatagccaagtcagcaacataattcctctaaataaaattacattgtgctcacacagtgctggattattacatttaattgaagacaaagcatgcttgctcctagtactagcagcaagcttttcctcccctcagctggtaatgatggtaggagacagagatgaagttgcctatgtatgtcatatcaattcaatagctgcctggggtcaaacacctaggggttgtacattccattactgtaaatgattgagagctggtttgtggtatggttggctttgcctaagcatttttgaagatgaacagcatgtgcagccaaagaactaatttgctaattaaggtggaacaatcattctgaatgaaatataatcagagtactccgcagtttgttaagaagtattggggaggaggggaatgtgtctcacaataaaatgagttggaattgttgagttaaatgaatttaacctg

SEQ ID NO: 124913 - DNA, 2039 bp, Homo sapiens; identical to SEQ ID NO: 109601
  Payload ID: 4528
  Gene Symbol:
  Gene Name: DASS-161H22.6
  ENST ID: ENST00000453381
  CDS Start-End: 24-323

SEQ ID NO: 124914 - DNA, 1266 bp, Homo sapiens
  Payload ID: 4529
  Gene Symbol:
  Gene Name: DASS-312M4.10
  ENST ID: ENST00000414847
  CDS Start-End: 4-1152
cccatggcagtcttattcctcctcctgttcctatgtggaactccccaggctgcagacaacatgcaggccatctatgtggccttgggggaggcagtagagctgccatgtccctcaccacctactctacatggggacgaacacctgtcatggttctgcagccctgcagcaggctccttcaccaccctggtagcccaagtccaagtgggcaggccagccccagaccctggaaaaccaggaagggaatccaggctcagactgctggggaactattctttgtggttggagggatccaaagaggaagatgccgggcggtactggtgcactgtgctaggtcagcaccacaactaccagaactggagggtgtacgacgtcttggtgctcaaaggatcccagttatctgcaagggctgcagatggatccccctgcaatgtcctcctgtgctctgtggtccccagcagacgcatggactctgtgacctggcaggaagggaagggtcccgtgaggggccgtgttcagtccttctggggcagtgaggctgccctgctcttggtgtgtcctggggaggggctttctgagcccaggagccgaagaccaagaatcatccgctgcctcatgactcacaacaaaggggtcagctttagcctggcagcctccatcgatgcttctcctgccctctgtgccccttccacgggctgggacatgccttggattctgatgctgctgctcacaatgggccagggagttgtcatcctggccctcagcatcgtgctctggaggcagagggtccgtggggctccaggcagaggaaaccgaatgcggtgctacaactgtggtggaagccccagcagtacttgcaaagaggccgtgaccacctgtggcgagggcagaccccagccaggcctggaacagatcaagctacctggaaaccccccagtgaccttgattcaccaacatccagcctgcgtcgcagcccatcattgcaatcaagtggagacagagtcggtgggagacgtgacttatccagcccacagggactgctacctgggagacctgtgcaacagcgccgtggcaagccatgtggcccctgcaggcattttggctgcagcagctaccgccctgacctgtctcttgccaggactgtggagcggatagggggagtaggagtagagaagggaacaagggagcaagggaacaagggacatctgaacatctaatgtgagaagacaaacatccttctgtgagtcattaaaatctatgaaccactct

SEQ ID NO: 124915 - DNA, 2160 bp, Homo sapiens
  Payload ID: 4530
  Gene Symbol: DAZAP1
  Gene Name: DAZ associated protein 1
  Uniprot ID: Q96EP5
  ENST ID: ENST00000233078
  CDS Start-End: 162-1385
ggaggcagccgccgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaacca

SEQ ID NO: 124916 - DNA, 2290 bp, Homo sapiens
  Payload ID: 4530
  Gene Symbol: DAZAP1
  Gene Name: DAZ associated protein 1
  Uniprot ID: Q96EP5
  ENST ID: ENST00000336761
  CDS Start-End: 206-1342
cgcggcggcgcggggacgcgcggtgaccgttggcgccgaggggaggaggcagccgccgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatggcctgggttcctattctccagccccgccgggctgcggcccacactttgtttacagtcttatggtcaggctgagcagtgatgtggcctagcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 124917 - DNA, 2086 bp, Homo sapiens
  Payload ID: 4530
  Gene Symbol: DAZAP1
  Gene Name: DAZ associated protein 1
  ENST ID: ENST00000587079
  CDS Start-End: 95-1315
gcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaa

SEQ ID NO: 124918 - DNA, 1021 bp, Homo sapiens
  Payload ID: 4530
  Gene Symbol: DAZAP1
  Gene Name: DAZ associated protein 1
  ENST ID: ENST00000592453
  CDS Start-End: 40-1021
ggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaaccagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatg

SEQ ID NO: 124919 - DNA, 2157 bp, Homo sapiens
  Payload ID: 4530
  Gene Symbol: DAZAP1
  Gene Name: DAZ associated protein 1
  ENST ID: ENST00000592522
  CDS Start-End: 162-1382
ggaggcagccgccgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaacca

SEQ ID NO: 124920 - DNA, 2598 bp, Homo sapiens
  Payload ID: 4531
  Gene Symbol: DAZAP2
  Gene Name: DAZ associated protein 2
  Uniprot ID: Q15038
  ENST ID: ENST00000412716
  CDS Start-End: 617-1123
aggcaacgactgtcctggggaagacagggcagcgaagattccagtgcaggtctcattcaggaaaggatacatgtgagctggagtggcaaaataaattttaacagagctgaagcttaagttgggcttggtggggagggacgcatgataaactaaggtgtggggagccgatttcaggcagtgcgacaaatttgcagaaatctaagcccctcgtggaaggttgccaaggtgaggtgaccttgagtgaatgcgtgtaggtggaaaaaggttccggggaatgcttgcatcgttctgcatccgagcgtccaacagagaaaagatcctgtttccagacaatacctgcatttggtttttctccagctgagggacaccggtagggggggggaggacagaaacgagcagggggtggggccaaggcgagtgggcgggaccgcgcggaccctcccgcggccgactggaggcccggagcaggggcggagtttccggcggcagcgccactcgggcgtcgggtgacgctaggcggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatgccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcctaa

SEQ ID NO: 124921 - DNA, 701 bp, Homo sapiens
  Payload ID: 4531
  Gene Symbol: DAZAP2
  Gene Name: DAZ associated protein 2
  Uniprot ID: Q15038
  ENST ID: ENST00000439799
  CDS Start-End: 83-343
gacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaag

SEQ ID NO: 124922 - DNA, 1811 bp, Homo sapiens
  Payload ID: 4531
  Gene Symbol: DAZAP2
  Gene Name: DAZ associated protein 2
  ENST ID: ENST00000436900
  CDS Start-End: 6-227
ccaccatgaacagcaaaggtcaatatccaacacagccaacctaccctgtgcagcctcctgggaatccagtataccctcagaccttgcatcttcctcaggctccaccctataccgatgctccacctgcctactcagaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatgccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattaca

SEQ ID NO: 124923 - DNA, 1117 bp, Homo sapiens
  Payload ID: 4531
  Gene Symbol: DAZAP2
  Gene Name: DAZ associated protein 2
  Uniprot ID: Q15038
  ENST ID: ENST00000425012
  CDS Start-End: 83-544
gacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctgtaaaagaagatcaagatcacgaccgagagcagggtgaggaagacaacggtgataacaacttggaaaggagagggaaaatgtagagatgtttcaggattgaggatgtctcagtagttcctggagtcatctgatttagtcactgttttcgtaaagatcctcttgttttcattaactagtgtccacttccatccaaacccatgttcccccaccaaccccaatttccatggcacataatagctggagtctcctggtgcttaagctaaggacacatgcttttgatttctgacaaaactgaactgcctcccaaaccagttcctgattcttaaagaaacgggaaggagggaacaggaaatggcttatcctaacaggaagtggtttatctgatcctccccctcttcctcacccactcaaccaaccacatatatcctcgtccctacccacgtactcaagtgtaacgtccgtatgcatatctatttgcggccacctcccaacctgtcatttactggtagtgcctctgacagaagcctccgagtcttttatggctgtgtgtgtgtgtgtgtgtgtgtgtgtgtgtgtgtaatataacttacaagccagagtgagcccattaatggatttggtcaggctccctctggagagagatgcccttgatccag

SEQ ID NO: 124924 - DNA, 2098 bp, Homo sapiens
  Payload ID: 4531
  Gene Symbol: DAZAP2
  Gene Name: DAZ associated protein 2
  Uniprot ID: Q15038
  ENST ID: ENST00000449723
  CDS Start-End: 185-625
cggaccctcccgcggccgactggaggcccggagcaggggcggagtttccggcggcagcgccactcgggcgtcgggtgacgctaggcggacggaccatcatgtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatgccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacacctcactgcaaggattctttacttagcttgtttttagatttcttctatatatattttatttatatcccatctagaattcagctaggtgctgctgctgctctgtttcctttgatgacgctttgaaataaaggcaggagtacaagcct

SEQ ID NO: 124925 - DNA, 601 bp, Homo sapiens
  Payload ID: 4531
  Gene Symbol: DAZAP2
  Gene Name: DAZ associated protein 2
  Uniprot ID: Q15038
  ENST ID: ENST00000549732
  CDS Start-End: 55-465
ggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaac

SEQ ID NO: 124926 - DNA, 587 bp, Homo sapiens
  Payload ID: 4531
  Gene Symbol: DAZAP2
  Gene Name: DAZ associated protein 2
  ENST ID: ENST00000551313
  CDS Start-End: 209-535
actgaattgctggagttggttcgtgggccggggcctgtgaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcactt

SEQ ID NO: 124927 - DNA, 872 bp, Homo sapiens
  Payload ID: 4531
  Gene Symbol: DAZAP2
  Gene Name: DAZ associated protein 2
  Uniprot ID: Q15038
  ENST ID: ENST00000549555
  CDS Start-End: 85-708
gtgacacggaagtagctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctgcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctctgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaag

SEQ ID NO: 124928 - DNA, 1045 bp, Homo sapiens
  Payload ID: 4531
  Gene Symbol: DAZAP2
  Gene Name: DAZ associated protein 2
  ENST ID: ENST00000604900
  CDS Start-End: 23-427
acaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctgtctgtgtcctgaagcttggcagatgagcgaacttagccagcacacccccggccgtgaagcagggaggtgaagcggggagagcaacgagccccacccgggtcttgccagctggacgttcttgtggggcagcgttgagcagcggttaggagtgccgtggactttggattcaaacagccccagctcttctgcttgctagctgggtgactttgggcaaattaacatctcgaaaatctgtttcctcattcctaaaatgcgggtctgaaagtgatcatgcctgtaaagccatctcatatccatggttctagaagcatggtgagcacctcaatttgaataatcagtgccatgctttagctacctcttgactcactcgtttgtggcaggaaatgttcccaaattaatcagaagaattcagtgactaagaggatgtaatagtatatagcgcaggcactggaatcagctctgctgtgtgatcttggacaagctgcttctgttccgtttctcttatctggggcaatacctgtctgaatagagtgactgttgggacgaaataggttagtaaatatgtactgtaaggcattagaaccttgcctggcacatagtaagtgctcaataaacgctaggtcttgttaccttggcttcccgtt

SEQ ID NO: 124929 - DNA, 7068 bp, Homo sapiens
  Payload ID: 4532
  Gene Symbol: DZIP1
  Gene Name: DAZ interacting zinc finger protein 1
  Uniprot ID: Q86YF9
  ENST ID: ENST00000347108
  CDS Start-End: 434-3037
tgttaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatgaacaggcattctcgtcgcacatactggaaccaatagaagaactttcagaggaagaaaaaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcactgtgactgtggctgtgttattagagatgaattctgagttaaatttgtacttattaggggtcttacagagggagaatctggccttgattgctatgccatatgacattctgtcctaatggttagaacaaatctttatctgtttccacccaccctgggatcctttttacttgtagcccattcctgccctctaaaagaatccttccaacttcctataggggccatttcatgcagatatactcactttatatgtatgtttctaaaagctttagtgaaggctgaatccaagtttcatgtagtaggacagagaacagaaggccgaatccaagtttcatgtggtaggacagagaacggcaatctacaaaactacaccaagcctaagatggcccatgtgccactttgttcattcatttatttattcagcagatatttattgaaccacttggtctggtttggttttgaacacgcactaattcatttaattacaacaactttgcgatgtagttattgttataatcctcatcctaaaggtgtgagaaacagagttattaagtaagttgccagaagccatacaagtacaaagtgtcaaggggagactttaagccaggtctctattccatgttttgtgtctgccatgttttcattcctgagcagaagagcttggggaaatgaacttttgctaagtaaacccagtatttaaattaagtcactatatctgtgtcttttaagagcccctcctttagcttacatggttagttgtatctttttttttttttttttttgagacagagtctcactatgttgcccaggcttgagcgcagtggcaccatctcggctcactacaacctccgcctcccagattcaagcgattttcctgcctcagcctcccaagtagctgggattacaggtgcccaccaccatgcctggcttaattttttgtatttttagtagagatgaggtttcaccatgttggccagactggtctcgaactcctgacctcaaatgatccgctgtcttgtcctcccaaagtgctgggattataggcgtgagccatcgcgccctgctgcatttcatttttttgtataaaatttggtttgttcgtttttgaggggaaccattcctttatgttgccccttactgatgcccaactaatgtgtttctggttactaacagaccttcatcccccaccctccctaaattcttcggtgtaatctaagcgttatctgcaccacttctgaataataaatgtgtttgaaatgcacacctacacaaccctgtcccacactggcctgtaggacctaatctaccttcatgtctttcagttgatttgtatttctgcaaaagatatttcaaggattatcaaggtatggaattttttttattttttatcttttaacaaacttgttcatttccttttctttccattgagcacctctgaacaatgtgattcttttttttaagtctttcacacttcaggaaaatactacattcacccacgttgtgattcatatcggacagtttcttactcaaagataacacaaataccaattcttattcatactttgaaactatattttaccctagactgccttggttcaaaggcctagtttcgacattactgtggcaaattatttaagctctctgttttcatttctttttctgtaaatgcaggatgaaaacaatatgtatctcctaggatggctgtgaggagtgagtgagacaggacatgaaaggtgtgtatgaactgtgataactgttgcccttgtgggcatgttatatagggctggctctaggaagaagcctgtgtcttttttcagaaatccctggagcaacttaaatgtctttagaaatgacaagtctctcagttatccagttagccgtaaacaggttctggaagacacacctagatagaactcggcccgtcagttctgagtgaggcacgtaccacttgggcttgggatgtccttaacccatttatgcctgaggttgcaattttttgaatttttccaatcacaccttggcgatgaccttgagcagtaggatataaataactcccacatgcttagtgttccaataatggaacactaggcataaacaggttttaattggctcctcagtcaaccatgaccaatatctctatctcagcttctgctgatgccctagctcagggctctgcattccgtgccagggacgcctcagccccttaacatggatgtgccacatgacaggcaataatatattggccccattagcccttcctggagcagtcataatgaattacagtcatgacaggcacatgtaagaaaccaaaatttgctaaatatgtacatgagtcttcatcacagcatcgtttatgaaaacaactaaatattcactaatggtgccagtggaataaatcagagaacatcccctgctacgtaactctctgcatacatcaaagagaatggtgtggctttgctttttcaacaatctactgagtggccatgggcatgtggatatggccatgaatgagcaagatcctctctgatcctgtagaagttaagttctaccagataacttgctgcttcaacaaaaagatttacctttttaaataaatgttgtagaatacttaaaaaaaacaaactagaatttgcctgtgtgcagccagtaacatgtctatttaacctggacaccttttgaggaatattctcagattgcccccatgctgtttataagacattgttccttatacacctgtttatgaatgaaaagaaacataaggagtgggtacaaagacttctatctatgaatgattaaaaaggctagagtacgaatacttcttgaacctttggtactaaatgcttttcatgttctatataaatgtagaaaacattttacaaatcctgtaaataaactgtttattttttatagaaagcc

SEQ ID NO: 124930 - DNA, 7011 bp, Homo sapiens
  Payload ID: 4532
  Gene Symbol: DZIP1
  Gene Name: DAZ interacting zinc finger protein 1
  Uniprot ID: Q86YF9
  ENST ID: ENST00000361156
  CDS Start-End: 434-2980
tgttaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaagtgaatgccccagccctgcacactttggaaactaaatcaagtctgccaatggtgcatgaacaggcattctcgtcgcacatactggaaccaatagaagaactttcagaggaagaaaaaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcactgtgactgtggctgtgttattagagatgaattctgagttaaatttgtacttattaggggtcttacagagggagaatctggccttgattgctatgccatatgacattctgtcctaatggttagaacaaatctttatctgtttccacccaccctgggatcctttttacttgtagcccattcctgccctctaaaagaatccttccaacttcctataggggccatttcatgcagatatactcactttatatgtatgtttctaaaagctttagtgaaggctgaatccaagtttcatgtagtaggacagagaacagaaggccgaatccaagtttcatgtggtaggacagagaacggcaatctacaaaactacaccaagcctaagatggcccatgtgccactttgttcattcatttatttattcagcagatatttattgaaccacttggtctggtttggttttgaacacgcactaattcatttaattacaacaactttgcgatgtagttattgttataatcctcatcctaaaggtgtgagaaacagagttattaagtaagttgccagaagccatacaagtacaaagtgtcaaggggagactttaagccaggtctctattccatgttttgtgtctgccatgttttcattcctgagcagaagagcttggggaaatgaacttttgctaagtaaacccagtatttaaattaagtcactatatctgtgtcttttaagagcccctcctttagcttacatggttagttgtatctttttttttttttttttttgagacagagtctcactatgttgcccaggcttgagcgcagtggcaccatctcggctcactacaacctccgcctcccagattcaagcgattttcctgcctcagcctcccaagtagctgggattacaggtgcccaccaccatgcctggcttaattttttgtatttttagtagagatgaggtttcaccatgttggccagactggtctcgaactcctgacctcaaatgatccgctgtcttgtcctcccaaagtgctgggattataggcgtgagccatcgcgccctgctgcatttcatttttttgtataaaatttggtttgttcgtttttgaggggaaccattcctttatgttgccccttactgatgcccaactaatgtgtttctggttactaacagaccttcatcccccaccctccctaaattcttcggtgtaatctaagcgttatctgcaccacttctgaataataaatgtgtttgaaatgcacacctacacaaccctgtcccacactggcctgtaggacctaatctaccttcatgtctttcagttgatttgtatttctgcaaaagatatttcaaggattatcaaggtatggaattttttttattttttatcttttaacaaacttgttcatttccttttctttccattgagcacctctgaacaatgtgattcttttttttaagtctttcacacttcaggaaaatactacattcacccacgttgtgattcatatcggacagtttcttactcaaagataacacaaataccaattcttattcatactttgaaactatattttaccctagactgccttggttcaaaggcctagtttcgacattactgtggcaaattatttaagctctctgttttcatttctttttctgtaaatgcaggatgaaaacaatatgtatctcctaggatggctgtgaggagtgagtgagacaggacatgaaaggtgtgtatgaactgtgataactgttgcccttgtgggcatgttatatagggctggctctaggaagaagcctgtgtcttttttcagaaatccctggagcaacttaaatgtctttagaaatgacaagtctctcagttatccagttagccgtaaacaggttctggaagacacacctagatagaactcggcccgtcagttctgagtgaggcacgtaccacttgggcttgggatgtccttaacccatttatgcctgaggttgcaattttttgaatttttccaatcacaccttggcgatgaccttgagcagtaggatataaataactcccacatgcttagtgttccaataatggaacactaggcataaacaggttttaattggctcctcagtcaaccatgaccaatatctctatctcagcttctgctgatgccctagctcagggctctgcattccgtgccagggacgcctcagccccttaacatggatgtgccacatgacaggcaataatatattggccccattagcccttcctggagcagtcataatgaattacagtcatgacaggcacatgtaagaaaccaaaatttgctaaatatgtacatgagtcttcatcacagcatcgtttatgaaaacaactaaatattcactaatggtgccagtggaataaatcagagaacatcccctgctacgtaactctctgcatacatcaaagagaatggtgtggctttgctttttcaacaatctactgagtggccatgggcatgtggatatggccatgaatgagcaagatcctctctgatcctgtagaagttaagttctaccagataacttgctgcttcaacaaaaagatttacctttttaaataaatgttgtagaatacttaaaaaaaacaaactagaatttgcctgtgtgcagccagtaacatgtctatttaacctggacaccttttgaggaatattctcagattgcccccatgctgtttataagacattgttccttatacacctgtttatgaatgaaaagaaacataaggagtgggtacaaagacttctatctatgaatgattaaaaaggctagagtacgaatacttcttgaacctttggtactaaatgcttttcatgttctatataaatgtagaaaacattttacaaatcctgtaaataaactgtttattttttatagaaagcc

SEQ ID NO: 124931 - DNA, 7418 bp, Homo sapiens
  Payload ID: 4532
  Gene Symbol: DZIP1
  Gene Name: DAZ interacting zinc finger protein 1
  Uniprot ID: Q86YF9
  ENST ID: ENST00000361396
  CDS Start-End: 840-3386
cgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaagtgaatgccccagccctgcacactttggaaactaaatcaagtctgccaatggtgcatgaacaggcattctcgtcgcacatactggaaccaatagaagaactttcagaggaagaaaaaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcactgtgactgtggctgtgttattagagatgaattctgagttaaatttgtacttattaggggtcttacagagggagaatctggccttgattgctatgccatatgacattctgtcctaatggttagaacaaatctttatctgtttccacccaccctgggatcctttttacttgtagcccattcctgccctctaaaagaatccttccaacttcctataggggccatttcatgcagatatactcactttatatgtatgtttctaaaagctttagtgaaggctgaatccaagtttcatgtagtaggacagagaacagaaggccgaatccaagtttcatgtggtaggacagagaacggcaatctacaaaactacaccaagcctaagatggcccatgtgccactttgttcattcatttatttattcagcagatatttattgaaccacttggtctggtttggttttgaacacgcactaattcatttaattacaacaactttgcgatgtagttattgttataatcctcatcctaaaggtgtgagaaacagagttattaagtaagttgccagaagccatacaagtacaaagtgtcaaggggagactttaagccaggtctctattccatgttttgtgtctgccatgttttcattcctgagcagaagagcttggggaaatgaacttttgctaagtaaacccagtatttaaattaagtcactatatctgtgtcttttaagagcccctcctttagcttacatggttagttgtatctttttttttttttttttttgagacagagtctcactatgttgcccaggcttgagcgcagtggcaccatctcggctcactacaacctccgcctcccagattcaagcgattttcctgcctcagcctcccaagtagctgggattacaggtgcccaccaccatgcctggcttaattttttgtatttttagtagagatgaggtttcaccatgttggccagactggtctcgaactcctgacctcaaatgatccgctgtcttgtcctcccaaagtgctgggattataggcgtgagccatcgcgccctgctgcatttcatttttttgtataaaatttggtttgttcgtttttgaggggaaccattcctttatgttgccccttactgatgcccaactaatgtgtttctggttactaacagaccttcatcccccaccctccctaaattcttcggtgtaatctaagcgttatctgcaccacttctgaataataaatgtgtttgaaatgcacacctacacaaccctgtcccacactggcctgtaggacctaatctaccttcatgtctttcagttgatttgtatttctgcaaaagatatttcaaggattatcaaggtatggaattttttttattttttatcttttaacaaacttgttcatttccttttctttccattgagcacctctgaacaatgtgattcttttttttaagtctttcacacttcaggaaaatactacattcacccacgttgtgattcatatcggacagtttcttactcaaagataacacaaataccaattcttattcatactttgaaactatattttaccctagactgccttggttcaaaggcctagtttcgacattactgtggcaaattatttaagctctctgttttcatttctttttctgtaaatgcaggatgaaaacaatatgtatctcctaggatggctgtgaggagtgagtgagacaggacatgaaaggtgtgtatgaactgtgataactgttgcccttgtgggcatgttatatagggctggctctaggaagaagcctgtgtcttttttcagaaatccctggagcaacttaaatgtctttagaaatgacaagtctctcagttatccagttagccgtaaacaggttctggaagacacacctagatagaactcggcccgtcagttctgagtgaggcacgtaccacttgggcttgggatgtccttaacccatttatgcctgaggttgcaattttttgaatttttccaatcacaccttggcgatgaccttgagcagtaggatataaataactcccacatgcttagtgttccaataatggaacactaggcataaacaggttttaattggctcctcagtcaaccatgaccaatatctctatctcagcttctgctgatgccctagctcagggctctgcattccgtgccagggacgcctcagccccttaacatggatgtgccacatgacaggcaataatatattggccccattagcccttcctggagcagtcataatgaattacagtcatgacaggcacatgtaagaaaccaaaatttgctaaatatgtacatgagtcttcatcacagcatcgtttatgaaaacaactaaatattcactaatggtgccagtggaataaatcagagaacatcccctgctacgtaactctctgcatacatcaaagagaatggtgtggctttgctttttcaacaatctactgagtggccatgggcatgtggatatggccatgaatgagcaagatcctctctgatcctgtagaagttaagttctaccagataacttgctgcttcaacaaaaagatttacctttttaaataaatgttgtagaatacttaaaaaaaacaaactagaatttgcctgtgtgcagccagtaacatgtctatttaacctggacaccttttgaggaatattctcagattgcccccatgctgtttataagacattgttccttatacacctgtttatgaatgaaaagaaacataaggagtgggtacaaagacttctatctatgaatgattaaaaaggctagagtacgaatacttcttgaacctttggtactaaatgcttttcatgttctatataaatgtagaaaacattttacaaatcctgtaaataaactgtttattttttatagaaagcca

SEQ ID NO: 124932 - DNA, 3738 bp, Homo sapiens
  Payload ID: 4532
  Gene Symbol: DZIP1
  Gene Name: DAZ interacting zinc finger protein 1
  Uniprot ID: Q86YF9
  ENST ID: ENST00000376829
  CDS Start-End: 853-3456
ggagccgggacaccgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggttctagggacgtatacttgagcaagagagaccacagctcttgttcccgctgatcctgcagcccagtggatggagtccagaatctacagacctgccaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatgcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttgagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatgaacaggcattctcgtcgcacatactggaaccaatagaagaactttcagaggaagaaaaaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcagatcagtgcagtgtttctcaaatggataccctttcaactggagaagtacccaaaatgatacaacttccttccaaaaacagacaactgattagacaaaaagctgtttctactgataggacatctgttccaaaaattaagaaaaatgtcatggaagatccttttcccagaaagtcttcaactattacgacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggta

SEQ ID NO: 124933 - DNA, 1783 bp, Homo sapiens
  Payload ID: 4532
  Gene Symbol: DZIP1
  Gene Name: DAZ interacting zinc finger protein 1
  Uniprot ID: Q86YF9
  ENST ID: ENST00000466569
  CDS Start-End: 1-834
atgcaagctgaggcagcggattggttttcaagcatggtaagaggcgggaggccggggcgcccccgacggggatgccgggctggggagaaccggggcttccccggacccccagctccccagcctgcccgccccccatccccgcctcccgccgcgctctctttgtgccccccgcagcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccagtgccatttttgtgacaaggcctttatgaaccaagcttttctacaaagtcacattcaacgccgccacactgaagaaaattctcattttggtcatctttgagattctgactttctactttggtttccatacctttcatgtctacactcacagacacatgtacatccattcagtcatgtgtacatctgcatagtatcagaaaaatgcacagattgagaagctccggagtgagatcgtcgtattgaaggaagagctgcagctcaccaggtctgagctagaggctgcacaccatgccagtgcagtcagattctccaaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatcaactgtcagaaatccagaagtccaatatgcagatcaagtccaacataggcacattaaaagatgcacacgagtttaaagaagaccgttctccatatccccaggatttccataatgtcatgcagcttcttgatagtcaggaaagcaaatggacagctcgagttcaagctattcatcaagaacacaagaaagagaagggtcggctcctgtcacatatagagaaacttcgaacctcaatgatagatgatctaaatgcaagcaatgttttctataagaaaaggatagaagagctagggcagagactccaggagcagaatgagctgattataactcagagacagcagattaaagactttacctgtaatccattaaacagtatcagtgaacccaaaggaaatcctttagcctggcaggcttttgaatctcagccagctgctccagctgtgcctatgaatgccccagccctgcacactttggaaactaaatcaagtctgccaatggtgcatgaacaggcattctcgtcgcacatactggaaccaatagaagaactttcagaggaagaaaaaggtaacaaa

SEQ ID NO: 124934 - DNA, 3493 bp, Homo sapiens
  Payload ID: 4533
  Gene Symbol: DZIP1L
  Gene Name: DAZ interacting zinc finger protein 1-like
  Uniprot ID: Q8IYY4
  ENST ID: ENST00000327532
  CDS Start-End: 364-2667
caagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggtgagcattccgggaaccatctctgggctgtctggggcggtggagcaagtctggaggcgggacgtggggcgagtatgggagccgccacctcgagacgtcttcccgccgtccccggctccaggagaccccacggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagaccagcctgggccagcagcagcgtggtcagcaggagctgggacgccaggctgacgagctcaagggtgtgcgggaggagagccgccggcgtcgcaagatgatcagcaccctgcagcagctgctaatgcagacaggcacccacagctaccacacgtgccacctgtgtgacaagacattcatgaatgccacctttctccggggccacatccagcgcaggcatgcaggcgtggcagaaggtggaaaacagaagaaacaggaacagccagtggaagaggtgttagaagagctacgggccaagctaaagtggacccaaggggagctggaagcccagagggaggcggagaggcagcggcagctccaggaagcagagctcattcatcagagggaaatagaagctaagaaagaatttgataaatggaaagagcaagagtggaccaaactttatggggaaatagataaactaaaaaaattattttgggatgaatttaaaaatgtcgccaagcagaactctacactagaagagaaactgcgggcactgcagtcccacagtgtgatggagtccaagctgggatcactgcgagatgaggagtcagaggagtggcttcggcaggcacgggagcttcaggccctgagagagaagacagaaattcagaaaacggagtggaaaagaaaagtgaaggaactgcatgaagagcacatggctgagaagaaagagctacaggaggagaaccagaggctccaggcctccctgtctcaggatcagaagaaggcagctgcccagtcccagtgccagatcagcaccctccgtgcccagctgcaggaacaagctaggatcattgcctcccaggaggagatgatccagtccttgtctctcaggaaggtggaagggatccacaaggtgccaaaggctgtggacacagaggaggactctccagaggaagagatggaggactcccaggatgaacagcacaaggtgctggcagctctgaggcgtaaccccactttgctgaagcacttcagaccaatcctggaggacaccctggaagagaagctcgaaagcatggggataaggaaggatgcaaagggaatctcgattcagactctcagacacctggaatccctgctgagagtccagcgggagcagaaggcccggaagttttctgaatttctgagtctgaggggaaagcttgtcaaggaagtcaccagcagagcgaaggagagacaggagaatggcgctgtggtgtcccagccagacgggcagccttcagtcaaaagccagcagagcacactggtcaccagagaggcccagccaaagaccaggaccctgcaggtggccttgccatccacaccggcagagccacccccaccaactcgtcagagccatggcagccatggctccagcctgacccaggtgtccgcccccgctccacgccccggactgcatggaccctccagcacccctccttcctcggggcccgggatgagcacgcccccgttcagttctgaagaggactcagagggagaccgtgtgcagcgtgtgtctctacagcccccaaaagttccttccaggatggtgccccggcccaaggatgactgggactggtctgacacagagacctcggaggagaatgcccagccccctggccagggctcaggaacactggtgcagtcgatggtcaaaaacctggagaagcagctagaagctccagcaaagaagcctgctggaggggtcagtctgttttttatgcccaatgctgggccacagagggctgccacaccaggaaggaagcctcagctttctgaagatgagagtgacttggagatctcctccttggaagatcttcctctggacctggaccagagagagaaacccaagcccttgtctcgctcaaagctcccagagaagtttggcactggtccacagagctctggccaacccagggtccctgcctggtgattcaccccagaagctagctggctagagggttagcctggctggggccagctcaggtccacttcaacagaagaggctgctgggcctcttgtcttcacaaacaaccaagagatcatcctcttggagagaagcagtgcagggaatggatatgatctcatccctcctgacctgtgaggggccctgctgtagatggccacaggtgcctgactaggagcccctaggtccccaggcttgagaaagggttaaaatagaacctccaggtagttttcttcctctacctccacatccccccaagactgaaaagagtcactaactctcttttcccaagccttttataaaactgcaggaacactgtggagatggttcctatctggggtccttttggggacatatgcctcagtcagtcattcagtgattgatccaaaattatttactgagtgcctacctactctgcgccaggctctctagcctctcactactgagttagggtgcaggcagaggctggggcagaatgtttacagccagtgccagcacaaggtagtaatctagtgacagagaacagggtgttatggggagcatatgagaggccatctatcccagcctgggtgatcctggagagtttcccagggttgtgatatgtggcaggcctactcatgggtgggaagggaggatggccacttggctggaccttgtatccccaaaggaccacacgtgtaatttttgatattatttccaaaatcaggttttatacatagccattgtatatttttagtgtgaaaaacattaatatattatatgcaaacatttaaatatagtacaatgtttttaa

SEQ ID NO: 124935 - DNA, 475 bp, Homo sapiens
  Payload ID: 4533
  Gene Symbol: DZIP1L
  Gene Name: DAZ interacting zinc finger protein 1-like
  ENST ID: ENST00000486487
  CDS Start-End: 1-445
acagcccccaaaagttccttccaggatggtgccccggcccaaggatgactgggactggtctgacacagagacctcggaggagaatgcccagccccctggccagggctcaggaacactggtgcagtcgatggtcaaaaacctggagaagcagctagaagctccagcaaagaagcctgctggaggggtcagtctgttttttatgcccaatgctgggccacagagggctgccacaccaggaaggaagcctcaggtaggatgtaggatgcttagagtttactctggaattctctacagaaccagctctgagtttggggggcctggggtgaaggttggggagggcccagcaagtgtcatcctttgccctagtgggacattgtgggtgacctccctctgcccctgtgcacatggagagatggccagtttggaatacttgtatccaagttaacattaaaaagccttttggttcattatataa

SEQ ID NO: 124936 - DNA, 2107 bp, Homo sapiens
  Payload ID: 4533
  Gene Symbol: DZIP1L
  Gene Name: DAZ interacting zinc finger protein 1-like
  Uniprot ID: Q8IYY4
  ENST ID: ENST00000469243
  CDS Start-End: 311-1930
aggtttgtaaatgattgcctggcagccaccttggaaacttggctccctcaagttctcctcttgactgcattcttgaggaagcagaagagacagacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagaccagcctgggccagcagcagcgtggtcagcaggagctgggacgccaggctgacgagctcaagggtgtgcgggaggagagccgccggcgtcgcaagatgatcagcaccctgcagcagctgctaatgcagacaggcacccacagctaccacacgtgccacctgtgtgacaagacattcatgaatgccacctttctccggggccacatccagcgcaggcatgcaggcgtggcagaaggtggaaaacagaagaaacaggaacagccagtggaagaggtgttagaagagctacgggccaagctaaagtggacccaaggggagctggaagcccagagggaggcggagaggcagcggcagctccaggaagcagagctcattcatcagagggaaatagaagctaagaaagaatttgataaatggaaagagcaagagtggaccaaactttatggggaaatagataaactaaaaaaattattttgggatgaatttaaaaatgtcgccaagcagaactctacactagaagagaaactgcgggcactgcagtcccacagtgtgatggagtccaagctgggatcactgcgagatgaggagtcagaggagtggcttcggcaggcacgggagcttcaggccctgagagagaagacagaaattcagaaaacggagtggaaaagaaaagtgaaggaactgcatgaagagcacatggctgagaagaaagagctacaggaggagaaccagaggctccaggcctccctgtctcaggatcagaagaaggcagctgcccagtcccagtgccagatcagcaccctccgtgcccagctgcaggaacaagctaggatcattgcctcccaggaggagatgatccagtccttgtctctcaggaaggtggaagggatccacaaggtgccaaaggctgtggacacagaggaggactctccagaggaagagatggaggactcccaggatgaacagcacaaggtgctggcagctctgaggcgtaaccccactttgctgaagcacttcagaccaatcctggaggacaccctggaagagaagctcgaaagcatggggataaggaaggatgcaaagggaatctcgattcagactctcagacacctggaatccctgctgagagtccagcgggagcagaaggcccggaagttttctgaatttctgagtctgaggggaaagcttgtcaaggaagtcaccagcagagcgaaggagagacaggagaatggcgctgtggtgtcccagccagacgggcagccttcaggctgaagaggaggaggaagaggaggggttgctcttgctgtctcacgggtggcagagtcggaagaaaatccacgtataagtggacccatggctgttcaaccccacgttgtttcggggtcaactgtatttcaaacattttctgatcttgaattactgtaagaaactcattttacattgtgaccc

SEQ ID NO: 124937 - DNA, 827 bp, Homo sapiens
  Payload ID: 4533
  Gene Symbol: DZIP1L
  Gene Name: DAZ interacting zinc finger protein 1-like
  ENST ID: ENST00000492010
  CDS Start-End: 710-827
aaaccggggcaagtccagcctctcagcaaggccaggaagccattcacttggatcctggattttactaacggattaaacgtggcattcccgccttcccccatccgttacagacctaaaaatagctcgtccgagaggggccgggagaggctccacctcttcttgaggtggggcggggcggctgtagtaggagctggaggcaccagagaccccaagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggtgagcattccgggaaccatctctgggctgtctggggcggtggagcaagtctggaggcgggacgtggggcgagtatgggagccgccacctcgagacgtcttcccgccgtccccggctccaggagaccccacggacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagca

SEQ ID NO: 124938 - DNA, 571 bp, Homo sapiens
  Payload ID: 4533
  Gene Symbol: DZIP1L
  Gene Name: DAZ interacting zinc finger protein 1-like
  ENST ID: ENST00000467030
  CDS Start-End: 371-571
cccaagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttg

SEQ ID NO: 124939 - DNA, 5350 bp, Homo sapiens
  Payload ID: 4534
  Gene Symbol: DZIP3
  Gene Name: DAZ interacting zinc finger protein 3
  Uniprot ID: Q86Y13
  ENST ID: ENST00000361582
  CDS Start-End: 231-3857
ttctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagacctcttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatatttaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaacggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccatatcacaccttaaggtcatggtcatatagctagttatcttgtaaaaccaatgtttcttagttcatacttacaactgcaatttcactttcatttagaaaagaataaatgtttcttaattgaacaacta

SEQ ID NO: 124940 - DNA, 576 bp, Homo sapiens
  Payload ID: 4534
  Gene Symbol: DZIP3
  Gene Name: DAZ interacting zinc finger protein 3
  ENST ID: ENST00000497905
  CDS Start-End: 364-576
gtttagctcctgggaaatgatgagattgatgattctttctcctggaaaacctttcatcacagagattcatctcagctgaacactgaacagcttagcagaggccttctgtcctctcttatctcatcaccagaggattttcctcccttcttttcatccttgctgtgatctatgcaaacagctactggccaaagaagagcttagcagagggggaggactccaagtctgagctttgataaattctggaaatgaggggattgttatctggaaaaggcgtacatttgtattctctagcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcac

SEQ ID NO: 124941 - DNA, 2076 bp, Homo sapiens
  Payload ID: 4534
  Gene Symbol: DZIP3
  Gene Name: DAZ interacting zinc finger protein 3
  ENST ID: ENST00000479138
  CDS Start-End: 115-2076
aggtattgctccggagggtgttactcgttagcgtcagtttttcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaa

SEQ ID NO: 124942 - DNA, 5164 bp, Homo sapiens
  Payload ID: 4534
  Gene Symbol: DZIP3
  Gene Name: DAZ interacting zinc finger protein 3
  Uniprot ID: Q86Y13
  ENST ID: ENST00000495008
  CDS Start-End: 208-1119
gagaagggggattcctcactcagctgtgcgctctgatttcgtgcgcttcctcgtccttcatgttggatggccagtttttcgtttgtgcgtcatcctctacctgagaaatggtcgcttgcccctagtctagacacgcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagtataagctctcattaatatttgagttagaagaacttattctgggcctttaatttgttgcatgtgctgtacttaaagcatcccagataattttagcttatattttcatagtgtttatacagagcttgaattggaatggtcctttccttccttgcctcagtacttccttccataatctttcctgccataaccatttattttgccaccatttcttaaacacttatgtggcaggcattatgctagactgtaatatgtttttttaatcccagttgaagtggatgtgggaaggtattagaaagtagaagaaagtatagtctaaaatagagaggaaagaaaggaagagaaaagtgggatatttcaaaaccatttgcgcagaggtagaatgaaattcgtccagaatggaatctccgtatttctttacaaataagtggtaacagttattatatagtcactaaattatccttagatctttcatcttataggcatgaatatgttgctttttaaaaagtgtcttcctcctttgttacatccatgtgtgtaagtgagcatctgtgaacttttatcagtaacctacttattgacattatgtgttgttcctttattcatcagtgattatttaaggacagaagactaggattaaaataaaaatgataaaaacaaaaataattgtttccatagaatctagaaagaaatacctataatattagaaaacaaaagatctcagtggtgagaggaaatatattttgcaaaataacccattgggcaatttgaattacatatttaataaataattttttacctactaggttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagacctcttgtgaaagaatctttctttagacccatacttactgttcctcaaatgcctgcagtttgcccgggagtcgtctctgcaactggccaacctagagcccccctgaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtacccatgaagagattatgaactacttgaaggtggagactgtacggtggtgtgttggagctggcttgtaatgtcttatgagtgacaatcgttagtttgaggaattttgtgagacagttgtcaaattgttgctagcttgaaatctgcggcaattggagtatttacaccatagaaatgctataagtgaagacctacctttcccttaagagctagttgttaaacctttaccagcataccactggaccttgtctaaaatttctttgtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagtt

SEQ ID NO: 124943 - DNA, 4246 bp, Homo sapiens
  Payload ID: 4534
  Gene Symbol: DZIP3
  Gene Name: DAZ interacting zinc finger protein 3
  Uniprot ID: Q86Y13
  ENST ID: ENST00000463306
  CDS Start-End: 130-3756
gatgagattgatgattctttctcctggaaaacctttcatcacagagattcatctcagcattaaagggcagtatttaaagtcagttggcaagcagtggaataagatttttgtaaagaaaccttgtgcagcatggattctctaccagatgaattttttgtgaggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggagacaaaaatgaccattggtttgacatagatcctacagaagatgaagatttacctacaacttttaaagatcttcttaataattttatcaagacaactgaaagcaatataatgaagcagacgatttgtagttacctagattgtgaacgatcttgtgaagctgacattttgaagaacaccagttataagggattttttcagttaatgtgcagtaaaagttgctgtgtttatttccataaaatttgctggaaaaagttcaagaatttaaagtatccaggtgaaaatgatcagagttttagtgggaaaaaatgtttgaaggaaggatgtacaggtgacatggtaaggatgctgcaatgtgatgtacctggaattgttaaaattttgtttgaagttgtgagaaaggatgaatatatcaccattgaaaatttaggagcaagttatagaaagttgatatctctgaaaataactgatactgatataagaccgaagatcagtttaaaatttaatacaaaagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggaattgctctacagtcaataacaggcagtcagcgtattgaaatagaagagttacagaatgaggaagaagaactaagtccacctctcatggagtacaatataaatgtgaaatcacaccctgagatacagtttgcagaaattaataaagatgggacctcaatacccagtgaatcttcaacagaatctcttaaagatctccaggaagttaagagtaaacaaaggaaaaagaagaagactaagaataaaaagaataaagactcaaaagaagaccaagtcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcagggctcagctggcaaagtaactacagactatggagaaactgaaaaggaaaggcttgctcgtcaaaggcagctttataaattgcactatcagtgtgaagatttcaaaagacagttgagaacagtgacttttcggtggcaagaaaaccaaatgcagattaaaaagaaagacaaaattatcgcatctcttaatcaacaagttgcttttggaatcaataaggtttccaaattacagcgtcaaatccatgctaaagataatgaaatcaagaaccttaaagagcaactttctatgaaaagatctcagtgggaaatggaaaaacataatctggaaagcacaatgaaaacatacgtaagcaaactgaacgcagaaactagcagagctttaacagccgaggtgtatttcttacagtgtcgtagggattttggtttgcttcatctagagcagactgaaaaggaatgtctcaatcagcttgccagggtgactcacatggcagcaagcaacctagaatcacttcaattaaaggctgcggtagacagttggaatgccattgtggcagatgttagaaacaagattgcattcctcaggacacagtacaatgaacaaataaacaaagtcaagcaaggatttgccttgagtaccttgcctccagtccagcttcctcctccaccacccagtcctgagatactgatgcagcagttcttaggaagacctcttgtgaaagaatctttctttagacccatacttactgttcctcaaatgcctgcagtttgcccgggagtcgtctctgcaactggccaacctagagcccccctgatgactggcatagcctgggctctgccagcgcctgtgggagacgctgtgcctcccagtgcaggtctgcggagtgatccctccatcatgaattgggagagaattacagacaggctgaaaactgcctttccacagcaaaccagaaaggaacttacagatttcttacggaaattgaaggatgcttatggaaaatccttgtctgaactgacatttgatgaaattgtttgcaagatttcccagtttattgaccccaaaaagtctcagagtcaaggaaaatcagtgtcaaatgttaattgtgtttcacctagtcattctccatcacagcctgatgctgcccagcccccaaaaccagcctggaggccactcacttcacagggtcctgccacatgggaaggagccagtaatccagatgaggaagaggaagaagaagagccttgtgtgatctgtcatgagaatctgtctccagaaaatctttcagttttgccttgcgctcacaaattccatgctcagtgcattagaccatggttgatgcaacaggggacatgtccaacgtgcagactccacgttttgctaccagaagaattccctggtcaccccagccggcagttgcccaagatctgatacaaggtcggggtgtctatgcaaaggaagctcagttttcttttattatgagctgcttgtttgagtggtgtaaaactatgtgctcttcaatatagtgctaaagaagccagctaattttatcaaagcagcagccaaagaagtcaggacaaatcttcaggacttgtgaaatgaactgaaagagcttgaagcagatggaattttaatagttacactatatatgctcttagtaggtttttttcttgtagtggaaacataactgttagcatatttcttaggatgttttttcttgtctttttaaattcttatttcactcatcctttactctcccctcaagtattctacactttaatttcctgaaataaatttaaggaaaagggaaatagtaaagaagtaggaatgggtgcagcacaccagcatggcacatgaatacacatgtaactaacctgcacattgtgcacatgtaccctaaaacttaaagtataataataat

SEQ ID NO: 124944 - DNA, 705 bp, Homo sapiens
  Payload ID: 4534
  Gene Symbol: DZIP3
  Gene Name: DAZ interacting zinc finger protein 3
  ENST ID: ENST00000486815
  CDS Start-End: 327-705
gctctgatttcgtgcgcttcctcgtccttcatgttggatggccagtttttcgtttgtgcgtcatcctctacctgagaaatggtcgcttgcccctagtctagacacggcatcctgctgtggaggatcagaggaaggaagaaactgagaataagctagaaaaatcatctggtcaactgaacaaacaggaaaatgacatacctactgatcttgtccctgttaacctactattagaagtgaagaagttattaaatgcaattaatactctaccaaaaggtgtggttcctcacattaagaagttcttacaagaagatttttccttccaaactatgcagagagaagttgcagctaacagccagaatggtgaggaaattgttcctgctttgactttacgtttcttgattacacagctagaagcagcacttaggaacattcaagctggcaattataccgcacaccagattaatattggttattatttgacattactgtttttatatggagtagcactcactgaaagaggaaagaaagaggattatacagaagctgagaataaatttctggtgatgaagatgatgatccaagaaaatgaaatttgtgaaaactttatgtctttagtttattttggacgtggtttactgcgatgtgctcaaaagagatataatggaggactgctagaatttcataaaagcttacaagaaattggag

SEQ ID NO: 124945 - DNA, 3907 bp, Homo sapiens
  Payload ID: 4535
  Gene Symbol: DBF4
  Gene Name: DBF4 zinc finger
  Uniprot ID: Q9UBU7
  ENST ID: ENST00000265728
  CDS Start-End: 505-2529
ctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggggaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttgggaggccgaggcaggctgatcacgaggtcagaagatcaagaccatcctggccaacatggtgaaaccttgtctactaaaaatacaaaaaattagctgggcatggcggcatgcgcctgtagtcccagctactccctccagaggctgagaattgcttgaacctgggaagtgcaggttgcagtgagccaagattgtgccactgtattccagactgggtgacagagtgagactccatctcaaaaaaaaaaaagttgactctaccccctaatttggtaggagatgaaggagaaaaggatggcattgaattatagatacagttttgggatatatacaaggattgccttgatctggcacttactgatacaagcatttggagaagagaaaattcaaatataagaaatttcaatttgaatctgtggatataaggcatttgcctttgagtatgttcttgtaggagtaagactaccaccagtgacattcaattggttctattgcatagtacatgaatctattgtcactaaaaattaggttactaatcttaatttttttgaaatatatgattctcagtacaggactaattcatatgcttttcctgcatacattattttgatcatttggataacatcaatgaacactggctttttaacacctttgtttttcataccagtacctgaagtaggctcaataaaagagtctttacagtg

SEQ ID NO: 124946 - DNA, 1274 bp, Homo sapiens
  Payload ID: 4535
  Gene Symbol: DBF4
  Gene Name: DBF4 zinc finger
  ENST ID: ENST00000430279
  CDS Start-End: 134-787
actgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaaaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatc

SEQ ID NO: 124947 - DNA, 2342 bp, Homo sapiens
  Payload ID: 4535
  Gene Symbol: DBF4
  Gene Name: DBF4 zinc finger
  ENST ID: ENST00000431138
  CDS Start-End: 200-334
cttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttaca

SEQ ID NO: 124948 - DNA, 2694 bp, Homo sapiens
  Payload ID: 4535
  Gene Symbol: DBF4
  Gene Name: DBF4 zinc finger
  Uniprot ID: Q9UBU7
  ENST ID: ENST00000413643
  CDS Start-End: 518-1222
agagccgcgccaactctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacatta

SEQ ID NO: 124949 - DNA, 2997 bp, Homo sapiens
  Payload ID: 4536
  Gene Symbol: DBF4B
  Gene Name: DBF4 zinc finger B
  Uniprot ID: Q8NFT6
  ENST ID: ENST00000315005
  CDS Start-End: 139-1986
aaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcagtgacccaaggcagggctgcgggccagcagcgatggacagaatcactagatggtgtgatgggacctcctgcaagtcacacatgtgtgagtgccacaaccctcctgccggccttgcccaagggctccagggagcagggctgcctctgtccctgcccagcctcctttacccagtctcatctggtcacttccttggctctgctgcctggggagtggtcgcctgcagaggacatgcccctccatccctcccaagaaaactcctttgccccggcggacattcctgttaagggcccactcctcttccctgaagccagaccgtggcttatgtctgcacgctgctgggttcgtccctttccttttgtgacatggggttgcctcattccccatgacaccacccctctgcatgaggaagtttccccttgcccctgtctcagacttggatacctttacctgctgctcacacaaagcctgtggtgccgggttcgggtgccctcattgtcaactgcaggacccattccccgaacctcacatccgtgtacccttgccttcccctcctatctcaatgatcatgaccttggacatctctgccaggccaaaccccaaggctggaacactcctcagccatttctccattgcggcttcctggctgtagactcaggttagaggtgaacccagaacacctgagacttgacccaggatggatgggtgctgcttgatgtgaatgaggtcccgcagtggctccttggcgtgagcactgctcagactcctttccactccagccccctttccacatcgcaccagatgacttttacccagacccagtgggcattgccttatcttgcagtcagtcccttttcaacatgttgccgtttctttctgaagaggtgtcctccctccacaagtcacactgtctgtccctggccctccagcccacctcgccaaccactcttgttggtttccttctcagacttgccacctttcccctctgccccaaaatgccatgctcctctcctggaaaacacttgagttgattcagtaaatcgacttcaaatacttgaaggctcccaccttctgttctctggctccttcctgcggtctatacctaccgcctcctcttcacctccttcccttccacacttccttcctgggtagctctgcctgaagcattccactaagatcatctattccaaggtcatggacaggctactggtgaccaaagttggttccttttctcctttctttcctccttgaagcctggctcccttggtcgcagcagcccctcagtggcctggttctcctgtccccctgcccttcctcaccattgcccattccctcgttcgttcattcagcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgcca

SEQ ID NO: 124950 - DNA, 1810 bp, Homo sapiens
  Payload ID: 4536
  Gene Symbol: DBF4B
  Gene Name: DBF4 zinc finger B
  Uniprot ID: Q8NFT6
  ENST ID: ENST00000393547
  CDS Start-End: 214-1509
gtagggcggatctcgcagctacggcgttcttttaggggtggagccggcaggaaatttaaactgaagccgcggccgaaaacgccaagagattgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccaggggagcatcagtggaggaggcagtgggggcagcagcagcctcctgaccaatgcccgctcttggggagtgaggattctgcacgtggatgaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcagtgacccaaggcagggctgcgggccagcagcgatggacagaatcactagatggtgtgatgggacctcctgcaagtcacacatgtcacaggccttgccgtctgccctgagtcagctccgagacacctgaagagccctccagccctaactactttactcagactaggtccccaggcctttgttcttgcctcttctcgctgagcctttcacttctcggcagatgtgaccgattggtagctccaccccaactcccttctgctgggtggaatgcaggagctagctgcctccaactcactgtgacctcagaaaaatgcctttattactcgggcctcagtttcctcgtctttaagtaaggggcttggatgagatgatttcaggaccctttccaataataaaatactgtgactgcca

SEQ ID NO: 124951 - DNA, 2998 bp, Homo sapiens
  Payload ID: 4536
  Gene Symbol: DBF4B
  Gene Name: DBF4 zinc finger B
  ENST ID: ENST00000526924
  CDS Start-End: 124-597
tgatgctgtagctgccctgagataaccaggactgtggaatcgggaagagctcatggagctcgcgaatgtaatacggaggcctctgaggaaggagtacggaggccgagaaggagccggcatttgatgagcgaaccgggaaagggagacgattgcctcgagctggagagttccatggctgagagtaggctccgggccccggacctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaattgagggttttctgagcaaagaagtaagttacatcgtgtccagccgcagagaagtaaaggcagagagcagtgggaaaagccatagaggctgccctagccctagccccagtgaggtcagagtggaaacatcggccatggttgatccaaaaggcagccaccccaggccttcacggaaacccgttgactcggtgcctctaagcagagggaaggagctgctgcagaaggctatcagaaaccagaaatgatgatgcacgtgcaacagctgtctcttgcgtctttatgtgtgaaaaaacaacagccaaagaagccagagggaacatgtccagcagcagagtcaagaacacggaaagtggccagactgaaggccccgttcctcaaaatcgaagatgaaagcaggaagtttcgtcctttccatcatcagtttaaatcctttcctgaaatttcttttcttggacccaaagatgcaagtccctttgaggccccgacgaccctgggcagcatgcaccataccagagaatccaaggatggagagccaagcccacgatcagctgcccacaccatgcccaggaggaagaaaggctactgcgagtgctgtcaggaggccttcgaggagctccatgtgcatcttcagagtgcccagcaccggagctttgccctggaagcccatctatatgcagaagtggacaggatcattgctcagctcagccacagctttgcagacatccctttccaggctggcctccccaggtggtcaggttccccagcttctgattgtgaccctctctgtcctgagactctgcacccccatcagccctcccatcccagggcagcatctcccaggataaggaaagaagacagctgccaggcatcaggtatcccagagcaggatgggacagtggacagcacgcaggcaccagctgaacgtgcagggactggtgaggtacctggacctatagcaagctgccaggacctgggggtgtcagttgatgtgtttgtggaccccccagggataccagtgtccaggagccctgcttgccaatgcctcctgcctagctctggttttatggaactctcctctggcccagacctggcactttttggccacaagcggaaggttcagttccccagtggcagtgctaagaagagagtgggggcctcctggccacaggcttcattttttgtcccaatagcccccaacccctgcggcaccaggacaactagtggcaagcgtcttccctctcttccccttacaggccatgagtccaggctcctcgcctccctccagcccttgtgccactcacagacctgcctctctctcccagaccccttcccctggcagcccacagacagaccagcagagttctgggccacacagccctcctggctggggaaagggtggcccccagggcctgaggattctgagtgtacagccactggccctgtatcccaggaggctggccagctcctcagctgccccacagctccaggctggccatcagctcccctgtactcagctaccagtgtgcagccctcgggagcacctgtagagagcaggtctacctccctcctgcagcccctgccagccagtgcgggagccagctgttcccgatgcctctgggccccccagcctctccaggtgccctgtctccctgtctcccagccctggtcccaaccccagccccagccccagccccatgctggcagagagctgctcctacgagtccccaaggtgcttggctcttcacagggccaggcagctccagattgaagggccacagatacaacttactcctctgctgggtgctgcacacccggccagggctgaccaggacgcaggaggggcagaaccccaggacttccccaaaagagctagaaggaggcccgggcctggcctttgaagtccagcaagcagctgtcacgctcagctccatggagctgacagagccacccctcccactggccaggtctttgggagagaatctgggctgggggctgccctctcctacccctgcctcctgccatgttcctgaccaggcagagtctacagtgggcttgcccagctgaggctggccgcccacgccaggaggcagaggcgaagttggcatggggagggaccacaaaggagctggggcagcaggagtcctggcccggcttcctggccctccacaggcccttgcctctctgcagagccgcgggttagctgttggtgtgctccacccccaaccccggcctcctttctcacgagcatgtggccgctcctgctttccaaaatgactgtgtttgtcccctcccccagccccccacgctcccgcacacagatcctcaggaacatatgaagcagaggaggggcttgggctgcaccactcacagagctccctcccccaggcacttagttggggcccagcactgacctttcccctgagcccaggatgtggccagagccccctctgggacccctctcgccccttctctgcctcctcagcttgagctgcctgcccgaagttcggctgttccggggccagtgtgtcacctgccaacttccacatcaccctcctccctcgctccctcctctccttccccaaggacctccccccatttctggcagccaagccattaatctggagacagaaatgggtttgctatcga

SEQ ID NO: 124952 - DNA, 3132 bp, Homo sapiens
  Payload ID: 4537
  Gene Symbol: DCC
  Gene Name: DCC netrin 1 receptor
  ENST ID: ENST00000304775
  CDS Start-End: 1-2318
gaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtatggtggctcaatctgtcattttgtgttccttgaatcaatcctgtctgttagacatgtcagtcattactttatattcctcttttcacctggaccatacacctgatgaagcagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatgaaataaatttttagtctctgtctgcacttctgaataattcacattaagtataattaagctcagcataattttcaagctgctcttgcaccctttcctgagctatggattaaagttctgtagctctacagagaaaacccgtaaa

SEQ ID NO: 124953 - DNA, 10206 bp, Homo sapiens
  Payload ID: 4537
  Gene Symbol: DCC
  Gene Name: DCC netrin 1 receptor
  Uniprot ID: P43146
  ENST ID: ENST00000442544
  CDS Start-End: 617-4960
gtagtacggttccaactcccagctcgcacaccgctggcggacaccccagtaacaagtgagagcgctccaccccgcagtcccccccgcctctcctccctgggtcccctcggctctcggaagaaaaaccaacagcatctccagctctcgcgcggaattgtctcttcaactttacccaaccgacgacaaggaaccagcctcaaccttttaatgcacagcccggccacaggattgccttccatctcctcttggtccctcctggatgtggtttattgatgacttgcgagcccctcagagagctgtcttccctcctctggctccctccgtttccttgagttagttttctaaggttttaccggggctcgggatctcttggaccgaatggaactttttgctgcctgcttttgctgctgattctgtcagtggacaaggaaaaaggcttcgaaggcagcagaggcgcaggggaggtggagaaagaggtggaggaagaggacgaggaggaggaggaagccgaaggggctcggcgcgtgtgtgtgcatgtgtgcatgcgtgtgtgagtgcatgtgtgtgagtgctgccgctgcccgcgacccctggccccgaaggtgttggctgaaatatggagaatagtcttagatgtgtttgggtacccaagctggcttttgtactcttcggagcttccttgttcagcgcgcatcttcaagtaaccggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcagacacatggtaattatatgcttaagcttgtaataggacagttttcaatttgggtggcttttgtgccataccacactgtgatacaatttcaaagcttcactaaggccatcttccttaggagtttggccagaagaatgcccccaccccttcaccccatccctccctgagttctccttggcaactagcgttgggtgaaatggccagctccacatgtcatatggtgcactggccaatgtcgcctgtcttctaatcccgtagaaatggcagactccctgagagcaggaagagaaggaaaataaaaggtagcttctaacagtaccttctcttaaagaatgccaactctgcctacagggtcagtgttggcaagcattggccaccagacccttttgttaagggaaacttttacactacacctgtgtcagagtcagggggaagcagaggggcaggtgccacctgacacttccgacatgtaaatccagcagatacttttcaaagcagcatcttaaactgtggactacagttttaaacttctattgccatgtttatctacagcttggaactagctaaaattaagaacattttgtatgcagcattttagtttctgaattttcagctgcatttggagttaatccctgtttatgcagctgaatcgccaaaagggagctagtttgcatatttatcagttaggtgacttgaaaacccaatgagagagtttcagctgaattattcctttcagctctgcctttgatttcaagcttgagtaggtcataattttaaaagagcatggaagggataggatctttacaacctaatagctccttttattaggtgggtaattatatatgaatccctgaataaaatattttgagcaaaatggcactgtaacagaagtaataattcagtttatttttttacagttttatgtcgggaaggaaatctgatgtcaaagagagggctgttcaaatggttcattagaaagtccggtccatttgcgaatttgttccttcaacaagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaaaaaaaaaaaaaacctatcattttcacaaatttctagatccttctagtcaaaaataattatttaggaaataaaatttttaaaaatccatttaaatacatgttatttgtcttcagtggaagttatatttctgctgcatgcttttgaaactttcttcattaaatagaatggtttgtcttagtaactggcaatgccagtattagcaccatgcatttaatctataatacaatcaatttaaacatcctcaaaaaactctagtatcatttacctggtagtattaatatacaatgatgtcaccacaacttttgtataactctgttccctttaccctcaaatgattcatatatgtatataattgcctgcccaagttttcaggtaacttattaatttcccagtctcctgatctcttgacaagaagaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctcttttttttaaaaaaaatggtatttttctttaaatttcaccctaataagaaagctattttctctcctctgcagaaatttctgcatttgtgaaacttataaaaatttagatagttcaaatgtataaagaatatttggatgatgctctagccaaaagttaaatatttcgtagtgaatcatagccaataagaaaccagtcatacttgcctctttgaataacagagatataagcttctagaatatttaaataatgaagttttacatttgggtattataaaatgcatactcaattgaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtcaatgaaagaaagaaaaatggaaaaattgtctagtttcaggcatgtttaaagaaaacaaagtcatctgaactttaaaatagatgcagagcagggttactttccctttcactcagttcccttcatgcaaccacaggcagtcctgcaggccagaggttactatcctaacctgctcataaccatatactatacagagcccacaactttctggagatgcagaagcagccatacactcaagtctctgtttttgtaaatcacattcaaagcaacattttactcataatttgcatttctctggtgactttcagaaatcactttagtattgtacagaaaagctttttatttgagtctagtgtttaaaattaaattggatacttgggaaaatcatagataggtgttttgtatgatattccattccaatgcaaaatatatgtacccatgcctcaatgtatcttgctatctaaatacctgttgccaaaaagtattgatttgggaaaaaaaatgccaatttcctggtcagtgaggttatgtaaaagacaaaataccacacccatatcagcaaatgaatattactactcatctggactcttcgttgccactattgcataacgttcacgtggcagacttccagttgcactctctgaaggacttttttctcttactctcaatagagagcctttgtacattgtcatcctatgattgttgttggtagaagagcaagagcaaaactctgcaagatttaataaacacaggggcatgggccaagggatctcactgtgtgctgaacatgtattttcagatgcaagaaaggaatgatggagaggaggagaaatgctgttttttattattgtagggtaaatctgacaattctgaactttgtgaattgtcagcttgtttgggggaagggtgggcgggtatggggtgtactttttataagtaatatttaatttattatttagagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaa

SEQ ID NO: 124954 - DNA, 9525 bp, Homo sapiens
  Payload ID: 4537
  Gene Symbol: DCC
  Gene Name: DCC netrin 1 receptor
  ENST ID: ENST00000412726
  CDS Start-End: 1-4275
tccctgtgctctcttgttccaggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtctaaaaagtattctttattgggtggaagcaacttgcttatctccaatgtgacagatgatgacagtggaatgtatacctgtgttgtcacatataaaaatgagaatattagtgcctctgcagagctcacagtcttggttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcagacacatggtaattatatgcttaagcttgtaataggacagttttcaatttgggtggcttttgtgccataccacactgtgatacaatttcaaagcttcactaaggccatcttccttaggagtttggccagaagaatgcccccaccccttcaccccatccctccctgagttctccttggcaactagcgttgggtgaaatggccagctccacatgtcatatggtgcactggccaatgtcgcctgtcttctaatcccgtagaaatggcagactccctgagagcaggaagagaaggaaaataaaaggtagcttctaacagtaccttctcttaaagaatgccaactctgcctacagggtcagtgttggcaagcattggccaccagacccttttgttaagggaaacttttacactacacctgtgtcagagtcagggggaagcagaggggcaggtgccacctgacacttccgacatgtaaatccagcagatacttttcaaagcagcatcttaaactgtggactacagttttaaacttctattgccatgtttatctacagcttggaactagctaaaattaagaacattttgtatgcagcattttagtttctgaattttcagctgcatttggagttaatccctgtttatgcagctgaatcgccaaaagggagctagtttgcatatttatcagttaggtgacttgaaaacccaatgagagagtttcagctgaattattcctttcagctctgcctttgatttcaagcttgagtaggtcataattttaaaagagcatggaagggataggatctttacaacctaatagctccttttattaggtgggtaattatatatgaatccctgaataaaatattttgagcaaaatggcactgtaacagaagtaataattcagtttatttttttacagttttatgtcgggaaggaaatctgatgtcaaagagagggctgttcaaatggttcattagaaagtccggtccatttgcgaatttgttccttcaacaagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaaaaaaaaaaaaaacctatcattttcacaaatttctagatccttctagtcaaaaataattatttaggaaataaaatttttaaaaatccatttaaatacatgttatttgtcttcagtggaagttatatttctgctgcatgcttttgaaactttcttcattaaatagaatggtttgtcttagtaactggcaatgccagtattagcaccatgcatttaatctataatacaatcaatttaaacatcctcaaaaaactctagtatcatttacctggtagtattaatatacaatgatgtcaccacaacttttgtataactctgttccctttaccctcaaatgattcatatatgtatataattgcctgcccaagttttcaggtaacttattaatttcccagtctcctgatctcttgacaagaagaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctcttttttttaaaaaaaatggtatttttctttaaatttcaccctaataagaaagctattttctctcctctgcagaaatttctgcatttgtgaaacttataaaaatttagatagttcaaatgtataaagaatatttggatgatgctctagccaaaagttaaatatttcgtagtgaatcatagccaataagaaaccagtcatacttgcctctttgaataacagagatataagcttctagaatatttaaataatgaagttttacatttgggtattataaaatgcatactcaattgaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtcaatgaaagaaagaaaaatggaaaaattgtctagtttcaggcatgtttaaagaaaacaaagtcatctgaactttaaaatagatgcagagcagggttactttccctttcactcagttcccttcatgcaaccacaggcagtcctgcaggccagaggttactatcctaacctgctcataaccatatactatacagagcccacaactttctggagatgcagaagcagccatacactcaagtctctgtttttgtaaatcacattcaaagcaacattttactcataatttgcatttctctggtgactttcagaaatcactttagtattgtacagaaaagctttttatttgagtctagtgtttaaaattaaattggatacttgggaaaatcatagataggtgttttgtatgatattccattccaatgcaaaatatatgtacccatgcctcaatgtatcttgctatctaaatacctgttgccaaaaagtattgatttgggaaaaaaaatgccaatttcctggtcagtgaggttatgtaaaagacaaaataccacacccatatcagcaaatgaatattactactcatctggactcttcgttgccactattgcataacgttcacgtggcagacttccagttgcactctctgaaggacttttttctcttactctcaatagagagcctttgtacattgtcatcctatgattgttgttggtagaagagcaagagcaaaactctgcaagatttaataaacacaggggcatgggccaagggatctcactgtgtgctgaacatgtattttcagatgcaagaaaggaatgatggagaggaggagaaatgctgttttttattattgtagggtaaatctgacaattctgaactttgtgaattgtcagcttgtttgggggaagggtgggcgggtatggggtgtactttttataagtaatatttaatttattatttagagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaagttc

SEQ ID NO: 124955 - DNA, 470 bp, Homo sapiens
  Payload ID: 4537
  Gene Symbol: DCC
  Gene Name: DCC netrin 1 receptor
  ENST ID: ENST00000582875
  CDS Start-End: 1-267
cgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcagagggaaatgtgaggctgagaaagtttggacaacatagccatggcagtttataactcaaagtatatggatggatgacactcgctagagagttgcaacagccgatgcagctgtccccaggccccaaactcacttatatttcctgaaacaccaggaaaagcatcttttatttttatatgagagccctaagagattattttcatcttattcaaaaatgaaaagattttatttaattaaaaaatctatttctattatctta

SEQ ID NO: 124956 - DNA, 546 bp, Homo sapiens
  Payload ID: 4537
  Gene Symbol: DCC
  Gene Name: DCC netrin 1 receptor
  ENST ID: ENST00000581559
  CDS Start-End: 1-213
gttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcagactaggtgtcatgtgatataactggacccaggagaatgaccccacaactgaaagatttttatgaaggatgatttactattctccaacgtactgacatttttctacagcccaatcattgctggggagaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaa

SEQ ID NO: 124957 - DNA, 621 bp, Homo sapiens
  Payload ID: 4537
  Gene Symbol: DCC
  Gene Name: DCC netrin 1 receptor
  ENST ID: ENST00000578080
  CDS Start-End: 1-545
aaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggagcaaatataagaattttgcctagaaggtcaacttcatcctgtgcagcagtctggaaaatgtatcccagggcccttgaatacgctcagaattctatttgggaaggtttggttacagtgcagagctttccattttacatttatagagatattgtttattttcaaatgataagcagaaaattaaattgctctgactctgtaattcttaatgacttaatgatcttcatttagctaaatgttcccattgttttgtagttaaagcatgagagaaagaaaaaataagaaataaatgtggtcttataagtaa

SEQ ID NO: 124958 - DNA, 444 bp, Homo sapiens
  Payload ID: 4537
  Gene Symbol: DCC
  Gene Name: DCC netrin 1 receptor
  ENST ID: ENST00000578949
  CDS Start-End: 139-444
ttgcacagagagaaaaggccatgtgagaacagagaaggtgttgtctggaagccagggagaggacccttactagaagccaactttgctgttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctc

SEQ ID NO: 124959 - DNA, 576 bp, Homo sapiens
  Payload ID: 4537
  Gene Symbol: DCC
  Gene Name: DCC netrin 1 receptor
  ENST ID: ENST00000579349
  CDS Start-End: 1-223
agttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggtctttgttcttagagctcccaagatggcggcaggccactcccaagatggcagcaagccttttattctctgacctggggttcttggcctcatggattccaaggaatggaaacttgggccatgtggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagcca

SEQ ID NO: 124960 - DNA, 750 bp, Homo sapiens
  Payload ID: 4537
  Gene Symbol: DCC
  Gene Name: DCC netrin 1 receptor
  ENST ID: ENST00000579941
  CDS Start-End: 1-626
tcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatgaaataaatttttagtctctgtctgca

SEQ ID NO: 124961 - DNA, 3517 bp, Homo sapiens
  Payload ID: 4537
  Gene Symbol: DCC
  Gene Name: DCC netrin 1 receptor
  ENST ID: ENST00000581580
  CDS Start-End: 266-3496
aagaagagttactggagcactctctccacccttgcacagagagaaaaggccatgtgagaacagagaaggtgttgtctggaagccagggagaggacccttactagaagccaactttgctggatccttgtgtttacattgaggccacccagataatccaggatattctactcatctcaagatccttaacttcacagctacaaagttcctttcaccagttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtgggaggaagcaacttacggatacttggggtggtgaagtcagatgaaggcttttatcaatgtgtggctgaaaatgaggctggaaatgcccagaccagtgcacagctcattgtccctaagcctgctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagttgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacagaatatagaggttgatggactatcttataaactggaaggcctgaaaaaattcaccgaatatagtcttcgattcttagcttataatcgctatggtccgggcgtctctactgatgatataacagtggttacactttctgacgtgccaagtgccccgcctcagaacgtctccctggaagtggtcaattcaagaagtatcaaagttagctggctgcctcctccatcaggaacacaaaatggatttattaccggctataaaattcgacacagaaagacgacccgcaggggtgagatggaaacactggagccaaacaacctctggtacctattcacaggactggagaaaggaagtcagtacagtttccaggtgtcagccatgacagtcaatggtactggaccaccttccaactggtatactgcagagactccagagaatgatctagatgaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttagagtcaagttcccattatgtaatctccctaaaagcttttaacaatgccggagaaggagttcctctttatgaaagtgccaccaccaggtctataaccgatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcagcccccacctctgctcccaaggacttgacagtcattactagggaagggaagcctcgtgccgtcattgtgagttggcagcctcccttggaagccaatgggaaaattactgcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaagtggaacaccctgacaaaatggctaatgaccaaggtcgtcatggagatggaggttattggccagttgatactaatttgattgatagaagcaccctaaatgagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtcaagacactgaggaagcagggagctctatgtccactctggagaggtcgctggctgcacgccgagccccccgggccaagctcatgattcccatggatgcccagtccaacaatcctgctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaacagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtggagatggagtgggtgaaacaatatgcaatctcttattatccccttttattaccagcatcttcattcagtgtatgaacaggatgatctgagtgaaca

SEQ ID NO: 124962 - DNA, 1931 bp, Homo sapiens
  Payload ID: 4538
  Gene Symbol: DCTD
  Gene Name: dCMP deaminase
  Uniprot ID: P32321
  ENST ID: ENST00000357067
  CDS Start-End: 67-636
gacttccttccctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatcta

SEQ ID NO: 124963 - DNA, 1972 bp, Homo sapiens
  Payload ID: 4538
  Gene Symbol: DCTD
  Gene Name: dCMP deaminase
  Uniprot ID: P32321
  ENST ID: ENST00000438320
  CDS Start-End: 292-828
tgaacaccgccggccggaccgcgggctgcgtcacggggaccgggaggcgtacggcgacgcggagcagcgcctttgcggcgtgcgacccgcccccgccgtccctccctccctcccctcagggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaa

SEQ ID NO: 124964 - DNA, 896 bp, Homo sapiens
  Payload ID: 4538
  Gene Symbol: DCTD
  Gene Name: dCMP deaminase
  ENST ID: ENST00000503820
  CDS Start-End: 676-896
gctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataa

SEQ ID NO: 124965 - DNA, 1874 bp, Homo sapiens
  Payload ID: 4538
  Gene Symbol: DCTD
  Gene Name: dCMP deaminase
  ENST ID: ENST00000507543
  CDS Start-End: 49-183
cggcggcggcggggacgagcaccggcctgcgcgcggagccggcaccggatgctgggcctcagtcctcacagggctctagtgggcgttcagccacaccaggagaaggcgcccaggggattaacaggacccttccctctcctgctcttccctcgccccccatggctccccctccctcctatttagtagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaa

SEQ ID NO: 124966 - DNA, 578 bp, Homo sapiens
  Payload ID: 4538
  Gene Symbol: DCTD
  Gene Name: dCMP deaminase
  ENST ID: ENST00000503182
  CDS Start-End: 72-578
accggccaagggtccccacggggacgctgcgacacagcgggctcactccagagacccaaaccagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaatt

SEQ ID NO: 124967 - DNA, 1027 bp, Homo sapiens
  Payload ID: 4538
  Gene Symbol: DCTD
  Gene Name: dCMP deaminase
  ENST ID: ENST00000503988
  CDS Start-End: 851-1027
tggcaccgtcccgagcgcgtggcgcggggcgctggctgccgggcgggggcctggggccgcggacgctgggggcgcctcggccgcgctcagcctttagatcggagaatgcgggcggggtgggggcgctcggggtccccgcagtcactccagggtcgatttctcggcgggcgccgcggcctgtgcgaggccgggccccttggagtgccccgggaggtggtgctgggcgtctgaacaccacatcccttcctgcgcccgtgtgtgggttgggaatgccgggtgtaggccctggatcagagctgacggggttgcgagcggcgtggggtgtgcctgggacggtgaccggatgtgtcttcctgaatcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtggtacccaccccgtttttgtgttgtcttccttccttgcccttgtttcattccttttgaaagcgaccactcccctgaagtcctaggacccccttcgtgggctctccctgccgtagacagtctctgcttgcccctgggagacagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatggg

SEQ ID NO: 124968 - DNA, 683 bp, Homo sapiens
  Payload ID: 4538
  Gene Symbol: DCTD
  Gene Name: dCMP deaminase
  ENST ID: ENST00000512766
  CDS Start-End: 327-683
agggcttcgggcccccggggccagccgccgtcctgcgaacgcgcggcgcccgggccgctgcccccttccggccccgcggcggccccgcctcctcccccgacttccttccctgagcacggcggcggcggggacgagcaccggcctgcgcgcggagccggcaccggatggtgggcgggggccagccgtgcgggcactgccgccctgcactgtagcagatgcctaaataaagtgtggagcctgaagcagaagttttgggagatgcttgccttcctttagaccacattcctcgcctttctcaagatttctccgtgggagacagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccag

SEQ ID NO: 124969 - DNA, 564 bp, Homo sapiens
  Payload ID: 4538
  Gene Symbol: DCTD
  Gene Name: dCMP deaminase
  ENST ID: ENST00000509757
  CDS Start-End: 65-199
cttccttccctgagcacggcggcggcggggacgagcaccggcctgcgcgcggagccggcaccggatgctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtg

SEQ ID NO: 124970 - DNA, 645 bp, Homo sapiens
  Payload ID: 4538
  Gene Symbol: DCTD
  Gene Name: dCMP deaminase
  ENST ID: ENST00000514754
  CDS Start-End: 350-645
ggttgccaggcctctcagatgtggggcagcgtaatcagtgggtgaccgtggttcccagcacccactctccactgcatccttgtcttaggcactgccgccctgcactgtagcagatgcctaaataaagtgtggagcctgaagcagaagttttgggagatgcttgccttcctttagaccacattcctcgcctttctcaagatttctccgtggtacccaccccgtttttgtgttgtcttccttccttgcccttgtttcattccttttgaaagcgaccactcccctgaagtcctaggacccccttcgtgggctctccctgccgtagacagtctctgcttgcccctgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaa

SEQ ID NO: 124971 - DNA, 794 bp, Homo sapiens
  Payload ID: 4538
  Gene Symbol: DCTD
  Gene Name: dCMP deaminase
  Uniprot ID: P32321
  ENST ID: ENST00000510370
  CDS Start-End: 231-767
ctcctcccccgacttccttccctgagcacggcggcggcggggacgagcaccggcctgcgcgcggagccggcaccggatggtgggcgggggccagccgtgcgggcactgccgccctgcactgtagcagatgcctaaataaagtgtggagcctgaagcagaagttttgggagatgcttgccttcctttagaccacattcctcgcctttctcaagatttctccgtgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaaga

SEQ ID NO: 124972 - DNA, 592 bp, Homo sapiens
  Payload ID: 4538
  Gene Symbol: DCTD
  Gene Name: dCMP deaminase
  ENST ID: ENST00000510307
  CDS Start-End: 232-592
atcgttgtattcgagctccagttctctctgtttctacagctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacgtgtgccatgcggagctgaatgccatcatgaacaaaaattcgaccgatgtgaaaggctgtagtatgtatgttgccttgttcccttgtaatgaatgcgctaagctcatcatccaggcag

SEQ ID NO: 124973 - DNA, 879 bp, Homo sapiens
  Payload ID: 4538
  Gene Symbol: DCTD
  Gene Name: dCMP deaminase
  ENST ID: ENST00000507631
  CDS Start-End: 94-219
gccccgcctcctcccccgacttccttccctgagcacggcggcggcggggacgagcaccggcctgcgcgcggagccggcaccggatgacccaacatgagtgaagtttcctgcaagaaacgggacgactatttggaatggccagagtattttatggctgtggccttcttatcagcacagagaagcaaagatccaaattcccagtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataatt

SEQ ID NO: 124974 - DNA, 1829 bp, Homo sapiens
  Payload ID: 4538
  Gene Symbol: DCTD
  Gene Name: dCMP deaminase
  ENST ID: ENST00000500813
  CDS Start-End: 90-215
cctgagcacggcggcggcggggacgagcaccggcctgcgcgcggagccggcaccggatggtgggcgggggccagccgtgcggacccaacatgagtgaagtttcctgcaagaaacgggacgactatttggaatggccagagtattttatggctgtggccttcttatcagcacagagaagcaaagatccaaattcccagtgtgccatgcggagctgaatgccatcatgaacaaaaattcgaccgatgtgaaaggctgtagtatgtatgttgccttgttcccttgtaatgaatgcgctaagctcatcatccaggcaggtataaaagaagtgattttcatgtctgataaataccatgatagtgacgaggcaactgctgcgaggctcctgtttaatatggccggggtgacattccggaaattcataccgaagtgcagcaagattgtcattgactttgattcaattaacagcagaccgagtcaaaagcttcagtgagttacatctcattcaatctccagaagattgggattatcgtcttctaagaggttgctaatgcctttcatcttgaagttacacataacttcttactagccagtatggcaaaagtaggcatctaaagaatataaagcctcaaatcttccttactgtctctcttgtcacatggaatctacatgtgtttgaactattgctttagggtttaaaataggggagcctgtggtggcctggtgcacagggctagaacgagagtgcctccccttcttgtgtcctggctggctgggatgctggtggctcttcagaggagcatcagctgtctgtcatctgctgcgatccggcagcctctcttcactgctacatgtgctggaaggacaaataaataattgtggttgtgttcttaatggggacgagcagacacactgatctgaacatctggcccaagtgaagcatggcatatagtgcccttggaagaaaattaggcctcaaatgacagtagcattgaagtgtttgctgcagagttgagggaaacccccagccaccctcccggaatccgagatagggtggcacatctgtcctgacagacgaggagtgtaactgaaccaggaatatttcctccattcctgctctcccactgcacacagggtggtggcacattatccctctggggggtggggacgcctgttgttttggctcaatttgggtttgttggtcacatggagctcttccatttcgtttagctgaataatgagttgttcctagaggagacagcctgtctctccttgttgcccccaaagcccatgccctgccgtggtggcagctggggctgtggatgggaggggtccccaacatggatgtgttgcccctcctccgcatgccaacgcagttcatgtacaaggcccctctgcaactggagagaaaattaattcctatcccgtgagtggattgtgagaaattccacccacgtggagacagcttactgcagcactgttggtgttcggagctcttctgtgccctggctccatgctttcacctacacaagcatcaccttcctaatcaccgcggggcggggagcgtgtggctgtgccccttctctttaatctcatttaatttttattaaacatgctcagtacctgtgttgagaaaaggctttctttatcctaaagattattacctttttaaagtgctcttatattttcatgagtttttattttgtctctgagattttgtattccacattctagggtattctgtaatttggctccttaccaatattattaaaatcttattaaaatctaccctaccaaagcatgtacatttttatgttattataattatatgc

SEQ ID NO: 124975 - DNA, 615 bp, Homo sapiens
  Payload ID: 4538
  Gene Symbol: DCTD
  Gene Name: dCMP deaminase
  ENST ID: ENST00000513348
  CDS Start-End: 33-86
gagcaccggcctgcgcgcggagccggcaccggatggtgggcgggggccagccgtgcggctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtgcagtgatgacgtgttgccttggagaaggacagcagagaataagctggacaccaaatacccgtacg

SEQ ID NO: 124976 - DNA, 332 bp, Homo sapiens
  Payload ID: 4538
  Gene Symbol: DCTD
  Gene Name: dCMP deaminase
  ENST ID: ENST00000508994
  CDS Start-End: 262-332
gcgaacgcgcggcgcccgggccgctgcccccttccggccccgcggcggccccgcctcctcccccgacttccttccctgagcacggcggcggcggggacgagcaccggcctgcgcgcggagccggcaccggatggcactgccgccctgcactgtagcagatgcctaaataaagtgtggagcctgaagcagaagttttgggagatgcttgccttcctttagaccacattcctcgcctttctcaagatttctccgtgacccaacatgagtgaagtttcctgcaagaaacgggacgactatttggaatggccagagtattttatggctgtggcctt

SEQ ID NO: 124977 - DNA, 568 bp, Homo sapiens
  Payload ID: 4538
  Gene Symbol: DCTD
  Gene Name: dCMP deaminase
  ENST ID: ENST00000509218
  CDS Start-End: 66-200
acttccttccctgagcacggcggcggcggggacgagcaccggcctgcgcgcggagccggcaccggatgctgggcctcagtcctcacagggctctagtgggcgttcagccacaccaggagaaggcgcccaggggattaacaggacccttccctctcctgctcttccctcgccccccatggctccccctccctcctatttagtaggtacttctccagcaccccacagcgatgatggatgctggccctaaagccaggcactgccgccctgcactgtagcagatgcctaaataaagtgtggagcctgaagcagaagttttgggagatgcttgccttcctttagaccacattcctcgcctttctcaagatttctccgtgggagacagacccaacatgagtgaagtttcctgcaagaaacgggacgactatttggaatggccagagtattttatggctgtggccttcttatcagcacagagaagcaaagatccaaattcccaggtcggcgcctgcatcgtgaattcagaaaacaagattgtcgggattgggtacaatgggatgccaaatgggtg

SEQ ID NO: 124978 - DNA, 7954 bp, Homo sapiens
  Payload ID: 4539
  Gene Symbol: DCUN1D1
  Gene Name: DCN1, defective in cullin neddylation 1, domain containing 1
  Uniprot ID: Q96GG9
  ENST ID: ENST00000292782
  CDS Start-End: 155-934
cgaggtccggggctgcctcctcgggccgcgccgggccgccccgcactgcgcatgagcgggagccgggcaagcccgtgagaggagccgccgccgccgccgccgtccattcgctgcggagccggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcgtggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttgtttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttttttcaatataaagtgttttctttaaaagtcatattggttcgtggcctagtgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaattgctttaactcctaagtgtttcagtcctcattccggtaaactccccatgctgattctttgttttaaactgaaccataggtacagtttcctttttgccaaatgtcaaaacaggtacaaattttaaaatgtaatgctttttaaatagaaaaatgtataaaattagaagtgcccacatataaaaaatacttgagatgaagattatctttagtgaatatcatctgcatatctctgtaagttcaattgtgtttcttacagtccctgtcatattaccaacagaggcaataaaagctgcagtgaaattgccatgactaaatcttttcacatatttcagtgtattttttttatagatttaaaatatacctgaaaacttttctaggaagaataattattcatggaaagagcattgtaatggcatgttttggggagaaaagacatgccaagtcttgtttactacatttaagatgtttacaactatactgggctgctttattaacaatactgtacttgcataatatggcattataagtacatgtccttccttagacttttaaaaagttttaatgagagaaagtaaatttactcaacaaaataacatgagaaatcctttacgtaatatctttactggggaattcttatttaagcaaggtacactattttttcctcagacttaaatgaatgaagtgttcatttattttttatttgatgataatcaagaagtgagtagtagtagctaacttaatgtacactttgcttaggtttttaaacatgttactattaagactacgtattgtaaaccttctgtaattttcacatatgaatgacaggagaaagttaaacctaatcgaaggagttttggaataaaaaagtggtgctggggaaattcaccatggttcacaaagtatgcctttgtaaaactgaatcaacttttagcaagaattaatttatgtagttttaaatgttaaattgtgtatatttaacagaaaatacttatctggcacctcagcagttttaatgttaccttatacttttaacagtatgatttatattgaatacttagatgttttcataagattttatcaaatttgataatgtaatgataaaatgtttttttaaatgtgaactatttaacatataaatggggacacaaaacctgaattgtgatttctacataatgtgataattagggttcaaattatgactcatcatttaattgattataaatgagtatatttctgaactctttattgcctccatttttacaatcataatatagcaataatttctatttttatttcataggactgtggtgaagttatttatcatgacacctttatctttgatttctgagggaaaggggtgtatattttgtagttaagataaatgagaaagttcctaatagtacaaatgcccttttccaggtttatctttgctatttgttgccatttttcttaaatatttgctttatttgtacccgatttctggaggcaaatagtgctgttttttcaaactcataatatagttacataaatgattttatcagagcattcttgctatcttattttctttcctacctgttgagtaagtagcatttcttgctcaccaactcatttatttgactaggttcagtgtttcctattaatgtgtttttttattttcctttggttgattttgaaaaatctgtcacaaataaggaagttatggtaaaagatgcacagcctttgtagttagtggaattctcaataagtaatgtctttatggagttttaaagggaaattatttaaagggaatcatgttatagttgtccattttttaaattgagattttaaaagtgtttttaagtatagcccaattttctatttacttacaagtgcttcatgattgttttcttttttattttttgccatcatgctgtgcagaaatcataatgtagcttgtaatacttcagagcattggtcttgaagctgtaacttggggctgctgtccttcatgaggtagggccatagcaggcaggccctttcccacttcctttatggcattctacttttatctgttgtaggctgttagtgtttcatattcgatttggtttggggaaaaatactcagttaaaaaaattttttttaatgattggctttagagggactgttacctctttggcatatctgtcagcggaatggaaagaaatggagtcagactgaaattcatgccagcttaatcactgaaggcagcactgctttgaaaagaagaattttcaacccacatcgtaaaaacaaagcctgattggaaacaatgaagtgtttgaaacttaggggcagcatgtaagtggcttaatgagcaaacaaacggaacatactcattttatatttaaaaagtacatatatattcaaatgcatgttcatatgaatattataattttatttcaggttatgaaatattctgagaaaaccttatatctgatggaaaacttgggcaatacccaatacgaagcaagagatttttacaaaaagaaatactatagggcataaggttgggggaagaccaattaatgaaatggctaagggacaatgctaattaaatcgttaacagtgattttgtcacataattacatgacttatagctaaaagagcaatatttaatcagtaagatttagagatgggtgtacttggaatcctttgaaagcagcgtgtttagttttcaagcaaatgctaatgttcttaatcctaatagtatattagacttcgttgtgttgaatatatcaaatgaacgaactatgaaccagagctttaaaatagtgatttgtaagactttgttacaatggtacttaaaaaattgctttgtataatttacacactgtaaaattcacccattgtacatgtacaattaattgtttttagtaaacttaagagttgtgcagtccaattttagaacatgtccatcagcccccaaaatttactcctgctgctctgcggttaatttgctcctgcctccagccccacgcagccacactgatctgctttctgtacagatttaccctttctagaaatttcacagaggtagaatcatgcagttagtcttttatatctggcatctttcacttagcatgtttttgaggttcatccatgttgcagcttatacctgcgtgtagttcctttagttgctgacttagtgttcactgtttggatataccacattttgtttatccattcaccagttgatagacatttggctggcctacaattagtttttttaaattgcgaataataatgctatgaacattcataaatgtctttgtgtggacatgttttcatctcagattcctagttgtggaattgtcaggttgtgtggtaaatttatacctaacgtttttaaaaaaactgctgaactttttccaaagtggctgtacttctagaactattcctgccacagtgcatgcggactgccgtgtctgcacatccttgccaatacttgtcttttttattgcagccatcctggcgggtatttactttatgtgtgtgagttatacctaggcatcccaactcgtgtatcgattggatgtgcagtttgagtgagtttcaagtggcctcagcgattgctgtaaaattagttactctagtagacatgtactctcttggaggtagtattttctgtagtcagtgagggtaataataatacttccagtgggggttccagtccctcagtgatctctggtgagaagaaatgtgtcagcgaagagtggtgctgatggctggtgctttggctctgttattgtttgtaccaaggttgatacagctactcgactagcctatgactgactggtggtggtaattaaactttgtacagattactgtgtgcagatagttactgtcttaatattaagtttcccagagattttacttttgagatagctgagaattaacgactcttggaatttataaaaatttagttgataccatttagttgctgccagctgcctgtgttcttatacataggagacatcggagtgagtgctttttaaaaaattaatggcgtatgtcaggtatatgtaaaaggacaattgcataatgaactcatgttaacatgatcaatccatggccaatcttgatttatctaaatgccattcatctttgaacccctatttattttgaagcaaatcccagatagcaaatcatttcatttgtaaatatttcaatatgtatgtctaaaagataaggactgttaaataaaaccacaattctgttgttagacttaactgttaacagtttgttagtgttaataactacccagcagtgttcaagttgtgcctttttttttttttttccaattcaagtcaggattcaaataagattcctacattgcatacatctcaaatgtcctacccagtggatccccacactctccactctttggcttcaaattcatttttttgaaaaaacaatgattgctttagcactttaaatttctatgcaatttcaaatgtaaggtgaaattttgatgtacttaataaaaaaattctaacgaatatatttttcaagttaatgtagtatataagaagctattatatcaacagattttcctttaacttaaaaatacatcgtgacttgta

SEQ ID NO: 124979 - DNA, 504 bp, Homo sapiens
  Payload ID: 4539
  Gene Symbol: DCUN1D1
  Gene Name: DCN1, defective in cullin neddylation 1, domain containing 1
  ENST ID: ENST00000497606
  CDS Start-End: 119-504
agggggcaacggccttgcccctgcccctctgccggctccattgtgtctggtcggggactggggtctggggttccggaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcgtggaagttcagagcagcaacacagtgcgagttctccaaacaggagttcatggatggcatgacagaattaggatgtgacagcatagaaaaactaaaggcccagatacccaagat

SEQ ID NO: 124980 - DNA, 560 bp, Homo sapiens
  Payload ID: 4539
  Gene Symbol: DCUN1D1
  Gene Name: DCN1, defective in cullin neddylation 1, domain containing 1
  ENST ID: ENST00000487822
  CDS Start-End: 284-560
ttgctgggtctccactcctagctgttactgcaagtccatgcctctaccatgagggtggaggagttaagatcaacagatccacatgtaccttgaggtgacagactggctctggtgaatattcccattttcctttttagaagccgcccccagctgctcaacttatccgccgccgctcgtgcccgcttccagcctgcgtagacccggccgtggtcgtccggaaggaaccgcgtaggaaacggagaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcgtgga

SEQ ID NO: 124981 - DNA, 659 bp, Homo sapiens
  Payload ID: 4539
  Gene Symbol: DCUN1D1
  Gene Name: DCN1, defective in cullin neddylation 1, domain containing 1
  ENST ID: ENST00000492563
  CDS Start-End: 32-139
ggaggaggggagaggcctggaggacaccaacatgaacaagttgaaatcatcgcagaaggataaagttcgtcagtttatgatcttcacacaatctagtgaaaaaacagcaaccctcaagatgagaataaaattggaatagatggcatacagcagttctgtgatgacctggcactcgatccagccagcattagtgtgttgattattgcgtggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtac

SEQ ID NO: 124982 - DNA, 970 bp, Homo sapiens
  Payload ID: 4539
  Gene Symbol: DCUN1D1
  Gene Name: DCN1, defective in cullin neddylation 1, domain containing 1
  ENST ID: ENST00000469954
  CDS Start-End: 176-910
ggtggtcttggacagtttctcattgctgggtctccactcctagctgttactgcaagtccatgcctctaccatgagggtggaggagttaagatcaacagatccacatgtaccttgaggtgacagactggctctgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcgtggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgca

SEQ ID NO: 124983 - DNA, 567 bp, Homo sapiens
  Payload ID: 4539
  Gene Symbol: DCUN1D1
  Gene Name: DCN1, defective in cullin neddylation 1, domain containing 1
  ENST ID: ENST00000460412
  CDS Start-End: 274-567
attgctgggtctccactcctagctgttactgcaagtccatgcctctaccatgagggtggaggagttaagatcaacagatccacatgtaccttgaggtgacagactggctctgagtttcgctcttgttgcccaggctgaagtgcaatggcgtgatcttggctcaccgcaacctccgcctcccgggttcaagcgattctcctgcctcagcctcccaagtagctgggattacagaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcgtggaagttcagagcagcaaca

SEQ ID NO: 124984 - DNA, 461 bp, Homo sapiens
  Payload ID: 4539
  Gene Symbol: DCUN1D1
  Gene Name: DCN1, defective in cullin neddylation 1, domain containing 1
  ENST ID: ENST00000466812
  CDS Start-End: 237-461
tagctgttactgcaagtccatgcctctaccatgagggtggaggagttaagatcaacagatccacatgtaccttgaggtgacagactggctctgccgcccccagctgctcaacttatccgccgccgctcgtgcccgcttccagcctgcgtagacccggccgtggtcgtccggaaggaaccgcgtaggaaacggagaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgt

SEQ ID NO: 124985 - DNA, 3147 bp, Homo sapiens
  Payload ID: 4539
  Gene Symbol: DCUN1D1
  Gene Name: DCN1, defective in cullin neddylation 1, domain containing 1
  ENST ID: ENST00000632685
  CDS Start-End: 95-829
attcgctgcggagccggaggaggaggggagaggcctggaggacaccaacatgaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaagaccctcaagatgagaataaaattggaatagatggcatacagcagttctgtgatgacctggcactcgatccagccagcattagtgtgttgattattgcgtggaagttcagagcagcaacacagtgcgagttctccaaacaggagttcatggatggcatgacagaattaggatgtgacagcatagaaaaactaaaggcccagatacccaagatggaacaagaattgaaagaaccaggacgatttaaggatttttaccagtttacttttaattttgcaaagaatccaggacaaaaaggattagatctagaaatggccattgcctactggaacttagtgcttaatggaagatttaaattcttagacttatggaataaatttttgttggaacatcataaacgatcaataccaaaagacacttggaatcttcttttagacttcagtacgatgattgcagatgacatgtctaattatgatgaagaaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttgtttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttagaatagcagtacattttatgcaaatatggaaattattttaagaaacaatgacatatcaaaactgctttttacatgattttgaaatagactagaaagctttccctatagacatattaatattccaatcataactttaattcaagaatgcagttttaccaaaagaaaaatttgaaaatttctattcaggctactggaattggttattaaaagaaaaaggaaaaagaagaatcttgctgctttcagtatttcctgatttttttgtaaatataaagaggaacttcaattatgaaaaatttttaaaagatatatatatctatatatctatatatatgtactgttttgtttcctgtcttgaagattttgagttatggttattggtttcagattgattaattcacatatgctgtgttttgaaatgagatcccattagcttttttttttttttttttttttcaatataaagtgttttctttaaaagtcatattggttcgtggcctagtgccttggattttacatatttttctttttaaatgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgatt

SEQ ID NO: 124986 - DNA, 2626 bp, Homo sapiens
  Payload ID: 4540
  Gene Symbol: DCUN1D2
  Gene Name: DCN1, defective in cullin neddylation 1, domain containing 2
  ENST ID: ENST00000332592
  CDS Start-End: 36-416
agaagcgggcggcgcgggggagatggtgtgacagcatggagaagctaaaggctcttctgccaagactggagcaggagctgaaggacacagccaagtttaaagatttttatcagtttaccttcaccttcgctaagaacccagggcagaaaggtttagacttagaaatggctgttgcgtattggaaattagtgttatctggaaggtttaaatttttagatctctggaacacattcttaatggaacatcacaaaagatcaattccaagggacacctggaacctcctgctggactttggaaacatgattgcggatgatatgtctaactacgatgaagaaggagcttggcccgttcttatagatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccctaagggagaggatcttgtcgtagagtctaatgttttttaaaattggtgccagcaattcacgatttatattttttgaattaccaaatatctagatttaccagctctatttttgttttcattttctctagacattcatctgaaaatcattttatggttctcaatccccatgtagctttgcatagcaacggcacacgtggcacgattccagcagagtttatctcacaccgtttatatatcactgggcctctcttacttaaatattatttgacctgcctgagaagcttcataaagtatgtttttttaaaatatattttaattacatttaaaaagacatttttccatgaaaaacatttattttatgagtgatgaattatagattttaaaatcaaggccgggcgtggtggctcacacctgtaatcccagcattttgggaggccgaggcaggtggatcacctgaggtcaggagtttgagaccagcctggccaacatggtgaaaccctgtctctactaaaaatacaaaaattagccgggcatggtggcacatgcctgtaatcccagctactcaggaggctgaggcaggagattcgcttgaactcaggagacggaggttacagtgagtcgagatcgcgccactgcactccagcctggacgacagagtgagattctgtctcaaaataaatacatacatacatacaataaaaccgaatgagctggttctttccatcctcttgtggtacccgtagtgcccagcatccagacctttgtgcccctgtgcacatttggaagctaaaatgtacatcgttgtctgaaaaaacccaaccccaaaaccttcatctgattggtgagctgaagtctgtccttgcaccatgttatcatctgtttctcgtgtccgcctggttgaggaggacccacgagtgctgccgaggtgtggagggctggtattgagttgtggacatcactgttgaccctacctcacgtgccgagactctcatgtcacaggcgtgccttgctgcccccctgcagcactgtgcaggacgtggaccagctggagctgctgcccagcacagaggagagtcgccgcagatgacctagctgcggtgtgagagagcatggcccagacaagcagctgggttggcttctgagaacaggacttaccctgggcttcaggaacatctgatggctgaggttagtgtgcttggaggctgcaggacgaactgtcgatgtttcttagcagagatggtcacagagggcagcagggacaggactggaagggacctgcagcctgcagaccccgcctggcccccgctggcttctggctggtccagtgatgggcaagtgacagaccttccccaggctctgcttccagaactctaatgggaaactgggcctgtctacctttagaagtcttcgattctcagagagcatttgtctaatacaataaaaactggcattaatacaaacctcaaaaacgtgagcgtatcttccaggcttcatggattcttgacatgtaattgttttgttcagaaaagtttatagaattcacataattctgtataaactatggagatccacagtacttttttgtttttgagatttaaagttctaagggattgtcaatagatatcaaaatattaatcattggacaaaggcttttccaaaaattgtgggtttttttcttctgttgtatccatttgagtcctgcatgctgtgaaatgctgagaacagaagcattaaattggtttttctcggg

SEQ ID NO: 124987 - DNA, 3164 bp, Homo sapiens
  Payload ID: 4540
  Gene Symbol: DCUN1D2
  Gene Name: DCN1, defective in cullin neddylation 1, domain containing 2
  Uniprot ID: Q6PH85
  ENST ID: ENST00000375403
  CDS Start-End: 23-583
agaagcgggcggcgcgggggagatgcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaaggacacagccaagtttaaagatttttatcagtttaccttcaccttcgctaagaacccagggcagaaaggtttaggttcacctccatttctcaatgtgaaagctttacatcattaagatgagttgaatatagatttcaattaatgttcttcctaagtgataaggatgtagacttataagcaggacaagactaatcatcttcttagcattttactgcgggtcccatcgacttagaaatggctgttgcgtattggaaattagtgttatctggaaggtttaaatttttagatctctggaacacattcttaatggaacatcacaaaagatcaattccaagggacacctggaacctcctgctggactttggaaacatgattgcggatgatatgtctaactacgatgaagaaggagcttggcccgttcttatagatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccctaagggagaggatcttgtcgtagagtctaatgttttttaaaattggtgccagcaattcacgatttatattttttgaattaccaaatatctagatttaccagctctatttttgttttcattttctctagacattcatctgaaaatcattttatggttctcaatccccatgtagctttgcatagcaacggcacacgtggcacgattccagcagagtttatctcacaccgtttatatatcactgggcctctcttacttaaatattatttgacctgcctgagaagcttcataaagtatgtttttttaaaatatattttaattacatttaaaaagacatttttccatgaaaaacatttattttatgagtgatgaattatagattttaaaatcaaggccgggcgtggtggctcacacctgtaatcccagcattttgggaggccgaggcaggtggatcacctgaggtcaggagtttgagaccagcctggccaacatggtgaaaccctgtctctactaaaaatacaaaaattagccgggcatggtggcacatgcctgtaatcccagctactcaggaggctgaggcaggagattcgcttgaactcaggagacggaggttacagtgagtcgagatcgcgccactgcactccagcctggacgacagagtgagattctgtctcaaaataaatacatacatacatacaataaaaccgaatgagctggttctttccatcctcttgtggtacccgtagtgcccagcatccagacctttgtgcccctgtgcacatttggaagctaaaatgtacatcgttgtctgaaaaaacccaaccccaaaaccttcatctgattggtgagctgaagtctgtccttgcaccatgttatcatctgtttctcgtgtccgcctggttgaggaggacccacgagtgctgccgaggtgtggagggctggtattgagttgtggacatcactgttgaccctacctcacgtgccgagactctcatgtcacaggcgtgccttgctgcccccctgcagcactgtgcaggacgtggaccagctggagctgctgcccagcacagaggagagtcgccgcagatgacctagctgcggtgtgagagagcatggcccagacaagcagctgggttggcttctgagaacaggacttaccctgggcttcaggaacatctgatggctgaggttagtgtgcttggaggctgcaggacgaactgtcgatgtttcttagcagagatggtcacagagggcagcagggacaggactggaagggacctgcagcctgcagaccccgcctggcccccgctggcttctggctggtccagtgatgggcaagtgacagaccttccccaggctctgcttccagaactctaatgggaaactgggcctgtctacctttagaagtcttcgattctcagagagcatttgtctaatacaataaaaactggcattaatacaaacctcaaaaacgtgagcgtatcttccaggcttcatggattcttgacatgtaattgttttgttcagaaaagtttatagaattcacataattctgtataaactatggagatccacagtacttttttgtttttgagatttaaagttctaagggattgtcaatagatatcaaaatattaatcattggacaaaggcttttccaaaaattgtgggtttttttcttctgttgtatccatttgagtcctgcatgctgtgaaatgctgagaacagaagcattaaattggtttttctcggg

SEQ ID NO: 124988 - DNA, 1025 bp, Homo sapiens
  Payload ID: 4540
  Gene Symbol: DCUN1D2
  Gene Name: DCN1, defective in cullin neddylation 1, domain containing 2
  ENST ID: ENST00000438545
  CDS Start-End: 1-734
gtcggcgcaggcggcgcgctggatgtgggaggccgagcccagcgagctgcgcggggcgttccgcgtggatccgagggaggaacgcgccgcgggcccgcgagccggagcggtggcgtcggaggcgcgggaccgcggggagcgcgggtttgacccggagccgcgagggacgaccgggacataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaaggacacagccaagtttaaagatttttatcagtttaccttcaccttcgctaagaacccagggcagaaaggtttaggttcacctccatttctcaatgtgaaagctttacatcattaagatgagttgaatatagatttcaattaatgttcttcctaagtgataaggatgtagacttataagcaggacaagactaatcatcttcttagcattttactgcgggtcccatcgacttagaaatggctgttgcgtattggaaattagtgttatctggaaggtttaaatttttagatctctggaacacattcttaatggaacatcacaaaagatcaattccaagggacacctggaacctcctgctggactttggaaacatgattgcggatgatatgtctaactacgatgaagaag

SEQ ID NO: 124989 - DNA, 562 bp, Homo sapiens
  Payload ID: 4540
  Gene Symbol: DCUN1D2
  Gene Name: DCN1, defective in cullin neddylation 1, domain containing 2
  ENST ID: ENST00000439909
  CDS Start-End: 292-562
agaagcgggcggcgcgggggagatgcgtgctgtataccgaaacagagtgaaagtgatccataaacttacgtagtttattcgatcaacatgattggcccgccagccccggaagactgtgcagtctttgtaactgatgaagagcaaggctttgtctctaattctgcccagttaaagtgcaggcgttaggctaaagctgggacaaacctggagcggcttcattggctttcctacttcttttgcatcccaaagcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatag

SEQ ID NO: 124990 - DNA, 460 bp, Homo sapiens
  Payload ID: 4540
  Gene Symbol: DCUN1D2
  Gene Name: DCN1, defective in cullin neddylation 1, domain containing 2
  ENST ID: ENST00000465710
  CDS Start-End: 409-460
gtcggaggcgcgggaccgcggggagcgcgggtttgacccggagccgcgagggacgaccgggagatgctggagaggagcgttccactgctgccgaggttggagatccaagagcagggatgaatttaactccccctccctctagcgtgctgtataccgaaacagagtgaaagtgatccataaacttacgtagtttattcgatcaacatgattggcccgccagccccggaagactgtgcagtctttgtaactgatgaagagcaaggctttgtctctaattctgcccagttaaagtgcaggcgttaggctaaagctgggacaaacctggagcggcttcattggctttcctacttcttttgcatcccaaagcataagcttaaatcgtctcagaaggacaaggtccgccagtttatggcgtgcactcaggctggcgagagaactgctatctactgcttaacgcaga

SEQ ID NO: 124991 - DNA, 499 bp, Homo sapiens
  Payload ID: 4540
  Gene Symbol: DCUN1D2
  Gene Name: DCN1, defective in cullin neddylation 1, domain containing 2
  ENST ID: ENST00000496873
  CDS Start-End: 141-499
gcacttcctggccggcgtggggcctggcagccgcaggctggcgttggaccccgcaggggcgagccaaggccctcgcagagggctggacgcgcaggggctgtggggcgcgagctcccgtgggcccccgggcggcgctgagcatgccgggagtgggagtccccgcggccggctcccggcactgccccggagccgagggccgcggccgtccgaggacgagggcggagccgccgccgcgcctgcgcagaaggccggggccggccagaagcgggcggcgcgggggagatgatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactgga

SEQ ID NO: 124992 - DNA, 2045 bp, Homo sapiens
  Payload ID: 4540
  Gene Symbol: DCUN1D2
  Gene Name: DCN1, defective in cullin neddylation 1, domain containing 2
  Uniprot ID: Q6PH85
  ENST ID: ENST00000478244
  CDS Start-End: 284-1063
agcacttcctggccggcgtggggcctggcagccgcaggctggcgttggaccccgcaggggcgagccaaggccctcgcagagggctggacgcgcaggggctgtggggcgcgagctcccgtgggcccccgggcggcgctgagcatgccgggagtgggagtccccgcggccggctcccggcactgccccggagccgagggccgcggccgtccgaggacgagggcggagccgccgccgcgcctgcgcagaaggccggggccggccagaagcgggcggcgcgggggagatgcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaaggacacagccaagtttaaagatttttatcagtttaccttcaccttcgctaagaacccagggcagaaaggtttagacttagaaatggctgttgcgtattggaaattagtgttatctggaaggtttaaatttttagatctctggaacacattcttaatggaacatcacaaaagatcaattccaagggacacctggaacctcctgctggactttggaaacatgattgcggatgatatgtctaactacgatgaagaaggagcttggcccgttcttatagatgattttgtagaatatgcacggccagtagtcacaggtggaaaacgcagccttttctaggcagcaagttaagcaggagtaagattatgaaatgatttgtatcctgcaaggagattgcagtcagttcctgggtgcattgtcgctgattccagaagtcattcttgaccagccatgaaaccagaggcgccatcccattctgccggaggacagccagcggctgctttgtggacaccgcaggaagttcctcgggacacggctgctttgggatgtttggagatttgtcatcatagcttttgcgttaggaaatttctgcatgattttttaatatttacaaaatactaaggtagagccatagcgccgcctgtgggaccgcagagcatgctgcgtagctcgcgcgtcaggcgaaccagcgtccggcagcgtcccgccgaatgacgttgcggtggcactggcaacacggcatgtgtcctctgcagggcgctgcgtttttatacacgtcaaagctgttaagaatgtgccctaagggagaggatcttgtcgtagagtctaatgttttttaaaattggtgccagcaattcacgatttatattttttgaattaccaaatatctagatttaccagctctatttttgttttcattttctctagacattcatctgaaaatcattttatggttctcaatccccatgtagctttgcatagcaacggcacacgtggcacgattccagcagagtttatctcacaccgtttatatatcactgggcctctcttacttaaatattatttgacctgcctgagaagcttcataaagtatgtttttttaaaatatattttaattacatttaaaaagacatttttccatgaaaaacatttattttatgagtgatgaattatagattttaaaatcaaggccgggcgtggtggctcacacctgtaatcccagcattttgggaggccgaggcaggtggatcacctgaggtcaggagtttgagaccagcctggccaacatggtgaaaccctgtctctactaaaaatacaaaaa

SEQ ID NO: 124993 - DNA, 578 bp, Homo sapiens
  Payload ID: 4540
  Gene Symbol: DCUN1D2
  Gene Name: DCN1, defective in cullin neddylation 1, domain containing 2
  ENST ID: ENST00000465938
  CDS Start-End: 177-578
gtgcagtctttgtaactgatgaagagcaaggctttgtctctaattctgcccagttaaagtgcaggcgttaggctaaagctgggacaaacctggagcggcttcattggctttcctacttcttttgcatcccaaagcataagcttaaatcgtctcagaaggacaaggtccgccagtttatggcgtgcactcaggctggcgagagaactgctatctactgcttaacgcagaatgagtggagactagacgaggccacggacagcttcttccaaaacccagactcgctccacagggagtccatgcggaacgctgtggacaagaagaagctggagcggctgtacggcaggtacaaagatccacaagatgaaaacaaaattggagtcgatgggattcaacagttttgtgatgatctgagcctggatcctgccagtatcagtgtattggtcatagcgtggaagttcagggcagcaactcagtgtgaatttagcagaaaggaatttctagatggcatgacagaacttgggtgtgacagcatggagaagctaaaggctcttctgccaagactggagcaggagctgaag

SEQ ID NO: 124994 - DNA, 6162 bp, Homo sapiens
  Payload ID: 4541
  Gene Symbol: DCUN1D3
  Gene Name: DCN1, defective in cullin neddylation 1, domain containing 3
  Uniprot ID: Q8IWE4
  ENST ID: ENST00000324344
  CDS Start-End: 287-1201
cggggcggccgccgccggtgggccgcagatgaagaggaggcggtggcagtggtggaagaagaggcggcggcggcgggggtagggagcctggaaacgcgagcggggatggtaggtggtttggacccgccgggccgccgtcgtttccagaaagggtttgactggaggaacctctggagcagctgttggctggctcctctggctgatggcatgttgaggtacatgggccagcggcagcgagggcatccaatccagaggggtccactctagaggccaggccaccagcaccatgggccagtgtgtcaccaagtgtaagaatccctcatcgaccctgggcagcaaaaatggagaccgtgagcccagcaacaagtcacatagcaggaggggtgcaggccaccgtgaggagcaggtaccaccctgtggcaagccaggtggagatatcctcgtcaacgggaccaagaaggccgaggctgccactgaggcctgccagctgccaacgtcctcgggagatgctgggagggagtccaagtccaatgccgaggagtcttccttgcaaagattggaagaactgttcaggcgctacaaggatgagcgggaagatgcaattttggaggaaggcatggagcgcttttgcaatgacctgtgtgttgaccccacagaatttcgagtgctgctcttggcttggaagttccaggctgcaaccatgtgcaaattcaccaggaaggagttttttgatggctgcaaagcaataagtgcagacagcattgacggaatctgtgcacggttccctagcctcttaacagaagccaaacaagaggataaattcaaggatctctaccggtttacatttcagtttggcctggactctgaagaagggcagcggtcactgcatcgggaaatagccattgccctgtggaaactagtctttacccagaacaatcctccggtattggaccaatggctaaacttcctaacagagaacccctcggggatcaagggcatctcccgggacacttggaacatgttccttaacttcactcaggtgattggccctgacctcagcaactacagtgaagatgaggcctggccaagtctctttgacacctttgtggagtgggaaatggagcgaaggaaaagagaaggggaagggagaggtgcactcagctcagggcctgagggcttgtgtcccgaggagcagacttagtggctctgtcccaggagcagcagcaaggatctgccagctgccctgcagccaactgaggaattggaccattttggaaattactgaagatccggatattttctactttacacctttctctgccttgtatctgaaagggctctaaaatgctgtatcatgttttaggcactttcttcatttttttggttattttggttatttcctttttggggggatctcccagaatatttgaacctggttacatgttgtgtatctttttttgaagccttcagatagaataagcctgccatttcttgcacaaatttaggttttttttttgtttttttttgtttttttttttttttttttggtaggggagggcatagagcagggcggggggatgggactgttaggttgaattaacattacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcatgttgtaagtggaaatacttttttttgtttgtttgtttcatttgccttggagccaaagtttctgttcctggtggtcgggaaactgcctgccggccaactgacttgaaggaaaactgtggtatggagctctgcttgaatttttttttttttaatatttttatttttttctttgaatatcatcagcttacttgtctggcaagggcagaagcctggggttggcctgaactctgccaaacaaatatcaaagtgtatttaatagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttatactggccataaaagagggagctgccttcaatgtataaagtataagaagagtgccagggaatgccataatggaggcttttggatctgaatttggaccatttcactaaagagaacatgagtttgctcagccctttcctcacaagagggagggccccggttccccagacttctccacgcgctggctccataaaggccagctttggccaggctgccacaggggcctgaggagctcactctgggcctacctggtttcagttagagggtcctcctgttatttttccatttaaaaagtatgtcctcagaaaactgtactggaaggatgggtggcaggaacttgtatagttcagcttccaacactttggaacagattaaaaagggaatcttttaaataaaaacgtataaaaatatttatactcttgaggtaatgagactttgtctgttaaacatttggaggtttctcccttaacctaataccccgctgcgtcccaggtatgtttctcagcctgggcaggaattgcatgttttgagttccattgtgagcagccttacagctctgggctcccatcttaaggattattaaagagttttggcagttggtatttttctaaaactgatattgaccatagggaacatacttggaatttgtttttttttttaaatcctaaacctgacagttcctccttcagaggggcaaatgggaaactttaagatcacccacggtatagtactgctagaaagctgaagggggtcttgggccagatgcctggcttctgttctagctaaataagactcttgaataagtctccaggggtcccagcaggttctgtgggatcagttgtagctgggtacccagactgaggttttaaaaagactgctttttcattaagccagtttgcaactcattttccccggttctggattgggtagtggttgactgagggaaaagccaggctgctcttggccagataaggccctttccatcccagatcagagtgtatcagagaaagctgcacaaaagaggcaggcagcccaggaccctgagtactctggagaaactaggttccttccccaccctttaagaagacattccgtgcattagatgtactagagtggatgtattttgttgttttttaaattaactatttagcctcctcatcccccaccaaaaaagccatttagttattttttggttatattgatccatttgcaaatgagaagccagaaaagggagcagtcagggagggacttacaagttcctttcaagtttgagtacttgatgctcagcaaagatttcaagcttctgcagtagctctgggccaatgcttgactctttcatgaccacaagaaatgcagtttttctgcaaagggatccaaggtgaggtgtgtgtagggtttgaagttatacttctgggaagtgaaaagtcttgttcctttcaacctagaaataggtttgccacttaatgagtgagcagtaagtctgtgtaagaggctgaatgcatgcccctcagataagccagtacactccttgcttagcaacagaacatcagggtgatgtggagaggggcaggatgtggacgccactttggaaatcggcaacatctgagggcaacaacaaacaagtgtgttgggaaataagaaataactcagttttgacaactggctttgtcagcttttgtgatgtttctttagcagtttattggaaagatggtatgagatgacgtgctgcttcattgaattgctctttcccccatctttgccaaatctcaatgtatcgttcttaaccccacctcctgtaaggggctttgctatgcttcagctggttgtctcagcagctgaagtgctgcccacctgtgtgagttgggtccaggaaaccatgtctgcccttctgataagggaagatgaatctagagctgggtgaagatctaaattttaaccaaacccctgggcccaggaaaataacaattgaaaatgtacaaggcagtgttttcaatattaaacttccccaaggaaagcacaaactagtctttttggaaagggagaaaggattaagccacacagtattagtctttgaagcagtactggtctctaggggctggtgccaaaatggagtcccatagtagttacactcgatggcctcatgtactatatactgtgccaaattgtattaaacagtggtggggagttactgggataagaacttgtctaaaagtttacaaaccaaaacagatctgttaggttggtgcaaaagtaagtttttgccatacttaatgtattgccattaagtatggcaaaaaccacaattacttttacaccaacctatgtatttaagaatgtttggtttgccagattccaaatgaggtcttcagtgcagcaaagcccaaaaggtgtagactcagttatgcaattataaggttaaggcgtagaagaaagctgctgctaggtttttgttgcattttacttgactgctctgctgtttttcttgtctctcatgtttggttagctatgacttgagcatcttggtaactgacaaaggtcttccttgggggacttgaacatcttggtaaatgacaggtcttcttggaggactccagcagtatcttgtttaaacgactgaaaggactattaaggttgttgaattgtgttaattgggactcattgaggaaatgcgacattgatcctcctcttattccacagtgtgttttctgatcatataaagaaggttccgaaccatccatccccctcagagtttattcccctggtaagctgtaattgcatatccagtttaaactggactgggactgcatgttggtgaggatcggcaggggttttcccccttttcgaaagatgaaatagattcttgagcactggttgcagaagccaaaatagttcaaatagctttgcataaccattgggttctgcttctgattcaggtgctgggcatcatgtcctccctattcttctcttcttggaaacccagcctatctcataaatacctacttccgccacccatccaacctccctgctcctttcaacacaaatcttggatattgccaaaggaagccattcagcagctgctggggtttttcatccccctgacatgcatacatttgctctgggagaagtgtcttccctctgaccctggtccccagctccgtctgtgcttaattgctcttacctgttgcactaatgaatatgactaggttttaaagggggaatgtgaagcaataggcacatggggcttggatgaattggtcccacagatataccctgccttaagccgctgaggtgatgagtccactgctcatgtgaccctccacctttgtggatccctcttggtttgtgaccagtgtgtctgtttgttgaggttgtacaaacttgacaaaagttaatacttttgtttgtattttctgcactgttgcactctccaaatggccccttgagtatttttattgacttgttacacacatttttgtctttgatgtctacattttttcctttaatgttttttatttggaaggttacctgctgttggatttaataaatttgtttacttgaa

SEQ ID NO: 124995 - DNA, 1996 bp, Homo sapiens
  Payload ID: 4541
  Gene Symbol: DCUN1D3
  Gene Name: DCN1, defective in cullin neddylation 1, domain containing 3
  Uniprot ID: Q8IWE4
  ENST ID: ENST00000563934
  CDS Start-End: 192-1106
agctgggctgagactgagggagagaagctggaggctgatcttggtccagcagaagctgagcagagctgctgtctttggtctttcaggttggctggctcctctggctgatggcatgttgaggtacatgggccagcggcagcgagggcatccaatccagaggggtccactctagaggccaggccaccagcaccatgggccagtgtgtcaccaagtgtaagaatccctcatcgaccctgggcagcaaaaatggagaccgtgagcccagcaacaagtcacatagcaggaggggtgcaggccaccgtgaggagcaggtaccaccctgtggcaagccaggtggagatatcctcgtcaacgggaccaagaaggccgaggctgccactgaggcctgccagctgccaacgtcctcgggagatgctgggagggagtccaagtccaatgccgaggagtcttccttgcaaagattggaagaactgttcaggcgctacaaggatgagcgggaagatgcaattttggaggaaggcatggagcgcttttgcaatgacctgtgtgttgaccccacagaatttcgagtgctgctcttggcttggaagttccaggctgcaaccatgtgcaaattcaccaggaaggagttttttgatggctgcaaagcaataagtgcagacagcattgacggaatctgtgcacggttccctagcctcttaacagaagccaaacaagaggataaattcaaggatctctaccggtttacatttcagtttggcctggactctgaagaagggcagcggtcactgcatcgggaaatagccattgccctgtggaaactagtctttacccagaacaatcctccggtattggaccaatggctaaacttcctaacagagaacccctcggggatcaagggcatctcccgggacacttggaacatgttccttaacttcactcaggtgattggccctgacctcagcaactacagtgaagatgaggcctggccaagtctctttgacacctttgtggagtgggaaatggagcgaaggaaaagagaaggggaagggagaggtgcactcagctcagggcctgagggcttgtgtcccgaggagcagacttagtggctctgtcccaggagcagcagcaaggatctgccagctgccctgcagccaactgaggaattggaccattttggaaattactgaagatccggatattttctactttacacctttctctgccttgtatctgaaagggctctaaaatgctgtatcatgttttaggcactttcttcatttttttggttattttggttatttcctttttggggggatctcccagaatatttgaacctggttacatgttgtgtatctttttttgaagccttcagatagaataagcctgccatttcttgcacaaatttaggttttttttttgtttttttttgtttttttttttttttttttggtaggggagggcatagagcagggcggggggatgggactgttaggttgaattaacattacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcat

SEQ ID NO: 124996 - DNA, 4312 bp, Homo sapiens
  Payload ID: 4542
  Gene Symbol: DCUN1D4
  Gene Name: DCN1, defective in cullin neddylation 1, domain containing 4
  Uniprot ID: Q92564
  ENST ID: ENST00000334635
  CDS Start-End: 181-1059
gagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcagaa

SEQ ID NO: 124997 - DNA, 4207 bp, Homo sapiens
  Payload ID: 4542
  Gene Symbol: DCUN1D4
  Gene Name: DCN1, defective in cullin neddylation 1, domain containing 4
  Uniprot ID: Q92564
  ENST ID: ENST00000381441
  CDS Start-End: 181-954
gagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacggcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcagaa

SEQ ID NO: 124998 - DNA, 4269 bp, Homo sapiens
  Payload ID: 4542
  Gene Symbol: DCUN1D4
  Gene Name: DCN1, defective in cullin neddylation 1, domain containing 4
  Uniprot ID: Q92564
  ENST ID: ENST00000451288
  CDS Start-End: 8-1018
ggggtgcatggaggtggaggcagcgttgggctgtagcgggcagggccggggatgtgggggggtggcaccggcggggagagggagggagcgagcgagcgagcggggcacaagggtgaggatttccaaagggctgagtggtgcgggcggctccgtgagaaaggcggattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcag

SEQ ID NO: 124999 - DNA, 548 bp, Homo sapiens
  Payload ID: 4542
  Gene Symbol: DCUN1D4
  Gene Name: DCN1, defective in cullin neddylation 1, domain containing 4
  ENST ID: ENST00000506673
  CDS Start-End: 141-332
aatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcagctttacaggaagtatggtgctggcatctgcttggcttctagagagtcttacaatcgtggaggaaggtgaatggagagcaggcacaccacatggcgaaagcaggagcgagagagagaaaggattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagac

SEQ ID NO: 125000 - DNA, 805 bp, Homo sapiens
  Payload ID: 4542
  Gene Symbol: DCUN1D4
  Gene Name: DCN1, defective in cullin neddylation 1, domain containing 4
  ENST ID: ENST00000509068
  CDS Start-End: 46-669
ggctggacgtgcgatgaagggccgagatcggagtgtccggggtgcatggaggtggaggcagcgttgggctgtagcgggcagggccggggatgtgggggggtggcaccggcggggagagggagggagcgagcgagcgagcggggcacaagggtgaggatttccaaagggctgagtggtgcgggcggctccgtgagaaaggcggattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacatggagtctcgcactgtcgccaggctggagtgcaatggtatgatgtcggctcactgcaacctctgcctcccgggttgaagcgatttcccctgcctcagcctcctgagtagctgggactacaggtagttatgcttgtcctagcttggaaattggatgcacaaaacatgggttattttactctacaggagtggttaaaaggaatgacttctctcca

SEQ ID NO: 125001 - DNA, 843 bp, Homo sapiens
  Payload ID: 4542
  Gene Symbol: DCUN1D4
  Gene Name: DCN1, defective in cullin neddylation 1, domain containing 4
  ENST ID: ENST00000505634
  CDS Start-End: 1-350
gaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggccgaagatggtgttagtgattgcgagctgctggctggcacccttgcagagcaggagaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatg

SEQ ID NO: 125002 - DNA, 577 bp, Homo sapiens
  Payload ID: 4542
  Gene Symbol: DCUN1D4
  Gene Name: DCN1, defective in cullin neddylation 1, domain containing 4
  ENST ID: ENST00000512199
  CDS Start-End: 1-66
aactttaaacttatttacagatatgcgtttgactttgcacggttctatatgatgcttgagagctgaaaggatcctcagaagtcatctggtccaggcctgtcaatgtaggatgatgagattgagagccagcgaggaggggcagcagcagggcccgcatctgcccttgacgtccaggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctat

SEQ ID NO: 125003 - DNA, 1584 bp, Homo sapiens
  Payload ID: 4542
  Gene Symbol: DCUN1D4
  Gene Name: DCN1, defective in cullin neddylation 1, domain containing 4
  ENST ID: ENST00000507741
  CDS Start-End: 91-165
agcttcgagccgaggtgcagtgagctggtggggggaccgcgaggcgagcgcgggagcctgggcggcgagccgggtgtgagctgcctgaaaatgcactcggatgccgccgctgtcaatatcagttttagagaatgtggcgtggagaaattctcaaggaaagagtaaaatgctggtgatgtgctgagggaacagaaggagtgtttgtgaatgtgcacacgtccgtttctggtctctcgtgtcagcgtcctacctgcacaaggttaaggcagcattaacagattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgcc

SEQ ID NO: 125004 - DNA, 4840 bp, Homo sapiens
  Payload ID: 4542
  Gene Symbol: DCUN1D4
  Gene Name: DCN1, defective in cullin neddylation 1, domain containing 4
  ENST ID: ENST00000477560
  CDS Start-End: 47-478
cgagcgcgggagcctgggcggcgagccgggtgtgagctgcctgaaaatgcactcggatgccgccgctgtcaattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtgagtcaaacttactgagttgggtgaatcagttggttgtttttcatacttaaatctttgttctttagcaaataaataaataattaaaaagtagtggtatgttagtttttatgaagcagtctaagaaataagttctaattctagtttgacttataagcagattctccattcttgtaagtgatatggtgtaactacagttattttttctctcatttaatttcttgtatgtaaaaggtacagtaagccagatgcttacaaaatggtgtggccacatgtgcctacaatgacggatcaactggaggccacattgtacgctgtgtaccttcgtgcccctcagtagttgttttagcctaatgtagagtcaatctaggacttataattattcatcatgattttgagtagattgtaatcatcaagaatttttcatagatcgtttacttccaattgaatttagctcagaagtgattgcttttttttttttgagatggagtctcgcactgtcgccaggctggagtgcaatggtatgatgtcggctcactgcaacctctgcctcccgggttgaagcgatttcccctgcctcagcctcctgagtagctgggactacaggtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacgggccgaagatggtgttagtgattgcgagctgctggctggcacccttgcagagcaggagaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttgccattcttgaggaaatatagagatgacatgttttcaccccaactatctggtgctattgaatgactaattcagtccctaaagttctgtgaaaacacaaaagtctaatgatttgagtgagtaaaaggtaatggtgcatttgaacaagtaaatgctgtcgtggtcagcaagatccgtgatttgaacatgtgatgactggaaaaaggtttgggttatttggaactctggctaaaacttctttcgggtgacatgtgatcgtttaaatggcattaagtgaataaagcacacagacagtgctactcttgaccactattttaccatttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcagaa

SEQ ID NO: 125005 - DNA, 2293 bp, Homo sapiens
  Payload ID: 4542
  Gene Symbol: DCUN1D4
  Gene Name: DCN1, defective in cullin neddylation 1, domain containing 4
  ENST ID: ENST00000509376
  CDS Start-End: 244-384
agtggggggcggggcctcgttgccagctccagaccggcgctatgggcactccttttgtcaaatgagagacgcagcagggcggcccctgagccgcggtttagccaatggagaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtgagtcaaacttactgagttgggtgaatcagttggttgtttttcatacttaaatctttgttctttagcaaataaataaataattaaaaagtagtggtatgttagtttttatgaagcagtctaagaaataagttctaattctagtttgacttataagcagattctccattcttgtaagtgatatggtgtaactacagttattttttctctcatttaatttcttgtatgtaaaaggtacagtaagccagatgcttacaaaatggtgtggccacatgtgcctacaatgacggatcaactggaggccacattgtacgctgtgtaccttcgtgcccctcagtagttgttttagcctaatgtagagtcaatctaggacttataattattcatcatgattttgagtagattgtaatcatcaagaatttttcatagatcgtttacttccaattgaatttagctcagaagtgattgcttttttttttttgagatggagtctcgcactgtcgccaggctggagtgcaatggtatgatgtcggctcactgcaacctctgcctcccgggttgaagcgatttcccctgcctcagcctcctgagtagctgggactacaggtagttatgcttgtcctagcttggaaattggatgcacaaaacatgggttattttactctacaggagtggttaaaaggaatgacttctctccaatgtgatacaacagaaaaactcagaaatactttggattacttaagatcattcttaaatgattctacaaactttaaacttatttacagatatgcgtttgactttgcacggcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgc

SEQ ID NO: 125006 - DNA, 548 bp, Homo sapiens
  Payload ID: 4542
  Gene Symbol: DCUN1D4
  Gene Name: DCN1, defective in cullin neddylation 1, domain containing 4
  ENST ID: ENST00000502930
  CDS Start-End: 111-251
gtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactctcatctctcaacactggcaaatattcataagatctaccacacccttaataagctggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacagg

SEQ ID NO: 125007 - DNA, 560 bp, Homo sapiens
  Payload ID: 4542
  Gene Symbol: DCUN1D4
  Gene Name: DCN1, defective in cullin neddylation 1, domain containing 4
  ENST ID: ENST00000510808
  CDS Start-End: 1-309
ttattttactctacaggagtggttaaaaggaatgacttctctccagaaaaggaccagcgcagcctagacataaacactgccaagtgcatgttgggactgttattaggaaaaatctggcccctttttccagtttttcaccaattcttagagcaatcaaaatacaaagttattaataaagaccagtggtgcaatgtcctagagtttagcagaacaattaatcttgacctcagcaactatgatgaagatggagcatggccagttttgttggacgagtttgtggagtggtataaagacaaacagatgtcctaggactttatgcatagcagcgagagagtcactgttaccacagttttgtcacccattagccataaattgctgtttgtatcaaagcgcatgctgcttctcttgcactgtttccctttcgcagggacatgttggtgtttgctattgaattggccagctctgcttgctgtgtggcattgttctcttggaaggctgctttgcagtttgtatttacactacagattggtgaatttgccaacgtcctcactgtgattatg

SEQ ID NO: 125008 - DNA, 645 bp, Homo sapiens
  Payload ID: 4542
  Gene Symbol: DCUN1D4
  Gene Name: DCN1, defective in cullin neddylation 1, domain containing 4
  ENST ID: ENST00000505403
  CDS Start-End: 8-645
ggggtgcatggaggtggaggcagcgttgggctgtagcgggcagggccggggatgtgggggggtggcaccggcggggagagggagggagcgagcgagcgagcggggcacaagggtgaggatttccaaagggctgagtggtgcgggcggctccgtgagaaaggcggattttcagctgaactctcatctctcaacactggcaaatattcataagatctaccacacccttaataagctgaacctaacagaagacattggccaagacgatcaccaaacaggaagtctgcggtcttgcagttcttcagactgctttaataaagtgatgccaccaaggaaaaagagaagacctgcctctggagatgatttatctgccaagaaaagtagacatgatagcatgtatagaaaatatgattcgactagaataaagactgaagaagaagccttttcaagtaaaaggtgcttggaatggttctatgaatatgcaggaactgatgatgttgtaggccctgaaggcatggagaaattttgtgaagacattggtgttgaaccagaaaacgtagttatgcttgtcctagcttggaaattggatgcacaaaacatgggttattttactctacaggagtggttaaaaggaatgacttctctcca

SEQ ID NO: 125009 - DNA, 1337 bp, Homo sapiens
  Payload ID: 4543
  Gene Symbol: DCUN1D5
  Gene Name: DCN1, defective in cullin neddylation 1, domain containing 5
  Uniprot ID: Q9BTE7
  ENST ID: ENST00000260247
  CDS Start-End: 344-1057
gattgcgtcacttccgggcctcagcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaa

SEQ ID NO: 125010 - DNA, 1310 bp, Homo sapiens
  Payload ID: 4543
  Gene Symbol: DCUN1D5
  Gene Name: DCN1, defective in cullin neddylation 1, domain containing 5
  ENST ID: ENST00000529281
  CDS Start-End: 306-521
gttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccaggtaccatctccccccacccttcaagcttccctcctccctcctttgctggacaactggaggaaaaggagtcgggcccggcctgccgggctggggctggagacagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttc

SEQ ID NO: 125011 - DNA, 808 bp, Homo sapiens
  Payload ID: 4543
  Gene Symbol: DCUN1D5
  Gene Name: DCN1, defective in cullin neddylation 1, domain containing 5
  ENST ID: ENST00000527260
  CDS Start-End: 1-586
ctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagatttgtgacaaaggccttaaagtg

SEQ ID NO: 125012 - DNA, 842 bp, Homo sapiens
  Payload ID: 4543
  Gene Symbol: DCUN1D5
  Gene Name: DCN1, defective in cullin neddylation 1, domain containing 5
  ENST ID: ENST00000527779
  CDS Start-End: 277-531
tggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatgtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgctt

SEQ ID NO: 125013 - DNA, 1535 bp, Homo sapiens
  Payload ID: 4543
  Gene Symbol: DCUN1D5
  Gene Name: DCN1, defective in cullin neddylation 1, domain containing 5
  ENST ID: ENST00000531571
  CDS Start-End: 290-493
tgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccaggtaccatctccccccacccttcaagcttccctcctccctcctttgctggacaactggaggaaaaggagtcgggcccggcctgccgggctggggctggagacaggtgaggcccctttgatcgagctaggctgtaggtgccgaacaccgcgagtctccgcgcccgacccgacctcgtgttcgagtgtgtgcacgctggcgtttatggagagactagaagagccgcccacgttaagagtctacgtgccctgcagggtggggaacagatgcatatctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaagattcagat

SEQ ID NO: 125014 - DNA, 727 bp, Homo sapiens
  Payload ID: 4543
  Gene Symbol: DCUN1D5
  Gene Name: DCN1, defective in cullin neddylation 1, domain containing 5
  ENST ID: ENST00000529294
  CDS Start-End: 1-205
gaagaagagaaaatcccctggggtggcagcagcagtagcggaagacggaggcctcaaaaagtgtaaaatctccaggtaccatctccccccacccttcaagcttccctcctccctcctttgctggacaactggaggaaaaggagtcgggcccggcctgccgggctggggctggagacagctattgcagatcccaaccccctgctagactaataagtggagaggaacatttttcaagcaagaagtgcctggcttggttttatgaatatgcaggtcctgatgaagttgtagggccagaaggaatggaaaaattttgtgaagacattggtgttgaacctgaaaatgtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtg

SEQ ID NO: 125015 - DNA, 790 bp, Homo sapiens
  Payload ID: 4543
  Gene Symbol: DCUN1D5
  Gene Name: DCN1, defective in cullin neddylation 1, domain containing 5
  ENST ID: ENST00000527576
  CDS Start-End: 283-375
tgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccaggtcctgatgaagttgtagggccagaaggaatggaaaaattttgtgaagacattggtgttgaacctgaaaatgtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggca

SEQ ID NO: 125016 - DNA, 1030 bp, Homo sapiens
  Payload ID: 4543
  Gene Symbol: DCUN1D5
  Gene Name: DCN1, defective in cullin neddylation 1, domain containing 5
  ENST ID: ENST00000531543
  CDS Start-End: 318-776
attcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccaggtgtgactgcacagaaaagttacaaaacaaatttgactttttgcgctcacagttgaatgatatttcgtcatttaagaatatctacagatatgcctttgattttgcaagggataaagatcagagaagccttgatattgatactgctaaatctatgttagctcttctgcttgggaggacatggccactgttttcagtattttaccagtacctggagcaatcaaagtatcgtgttatgaacaaagatcaatggtacaatgtattagaattcagcagaacagtccatgctgatcttagtaactatgatgaagatggtgcttggcctgttcttcttgatgaatttgttgagtggcaaaaagtccgtcagacatcatagcaagaactatgtgaagaaaatgcaaacctttcaattcccacgtgtatacaagctaatgtgatgagggggaaaaaaatccaacgggtgcattttcattcatatgaaagacttctcatagtacttttttttcctttttttaaaggaggtttttcttgttacatgtgatgggcattgagccacacctcttcttagactgaatattgaagtttttgttttgagttatgtttataacatttatttcagaacaataaaga

SEQ ID NO: 125017 - DNA, 651 bp, Homo sapiens
  Payload ID: 4543
  Gene Symbol: DCUN1D5
  Gene Name: DCN1, defective in cullin neddylation 1, domain containing 5
  ENST ID: ENST00000525420
  CDS Start-End: 323-415
cagcgattcgcctccgggttaggctgagcctcttgcttgctgtgactggtggagctgccgcgctgtccgcgttatctcctcccggtgagaacgaaccgcagtgtccaccggcgaggagccagccctgtcccggtcagagaaagacgacgaggatacctgggagcgggcggcggccgggctgggccgcgccggtgcgggctggcgactctgctcctccgcttgctgctgtctctgggaactgggtgccagcgctgaggggcttccagcggacagggacccccttccccggctcccctgcccaccctgccggggagggcggaagatgccggtgaagaagaagagaaaatcccctggggtggcagcagcagtagcggaagacggaggcctcaaaaagtgtaaaatctccaggtcctgatgaagttgtagggccagaaggaatggaaaaattttgtgaagacattggtgttgaacctgaaaatattattatgttagttttagcgtggaaattggaggctgaaagcatgggattttttaccaaggaagaatggttaaagggaatgacttcattacagtgtgactgcacagaaaagttacaaaacaaatttgactttttgcgctcacagttgaatgatatttcgtcatttaagaata

SEQ ID NO: 125018 - DNA, 290 bp, Homo sapiens
  Payload ID: 4543
  Gene Symbol: DCUN1D5
  Gene Name: DCN1, defective in cullin neddylation 1, domain containing 5
  ENST ID: ENST00000583974
  CDS Start-End: 1-129
attattatgttagttttagcgtggaaattggaggctgaaagcatgggattttttaccaaggaagaatggttaaagggaatgacttcattacagctttctataactgaattggctttcctttttgtgtgaaagaatttgtgggtatatgaactggatataactggcctagactagccattttgtgtgactgcacagaaaagttacaaaacaaatttgactttttgcgctcacagttgaatgatatttcgtcatttaagaatatctacagatatgcctttgattttgcaagg

SEQ ID NO: 125019 - DNA, 2279 bp, Homo sapiens
  Payload ID: 4544
  Gene Symbol: DCST1
  Gene Name: DC-STAMP domain containing 1
  Uniprot ID: Q5T197
  ENST ID: ENST00000295542
  CDS Start-End: 97-2217
gacccagttccgaggactggagaggggatagaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctctcctgctgggggcaggcgctggggggctcctggccataggtctctttcagctcctggtgaaccccatgaacatctacgaagaacagaagattatgttcttgtacagcttggtgggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagcagtcataaactggaggtgaaggtcgggggagactccatgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccgcgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtgaagaggcgtcctgctcgctcttccgcaccgtccttcccggttaataaaatgccctgtacgctt

SEQ ID NO: 125020 - DNA, 2207 bp, Homo sapiens
  Payload ID: 4544
  Gene Symbol: DCST1
  Gene Name: DC-STAMP domain containing 1
  Uniprot ID: Q5T197
  ENST ID: ENST00000368419
  CDS Start-End: 68-2062
agaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctctcctgctgggggcaggcgctggggggctcctggccataggtctctttcagctcctggtgaaccccatgaacatctacgaagaacagaagattatgttcttgtacagcttggtgggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagcagtcataaactggaggtgaaggtcgggggagactccatgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccggtcttcactgagcctcagtttctccctctgaagaatggcaagactggagagatctgtaaggcctgctcactggagatcagcctagagtggtggtcaggtgtgggactccggtgccagagggcctaagtgtgtatcccggctccttccctcattactatgacaacggtgtgaccttgagcacatgacttaactgctgtgcctgggcttttgccttccataaaatggggttaactactccatctggttgttttaaggattaaatgagttgtac

SEQ ID NO: 125021 - DNA, 2199 bp, Homo sapiens
  Payload ID: 4544
  Gene Symbol: DCST1
  Gene Name: DC-STAMP domain containing 1
  Uniprot ID: Q5T197
  ENST ID: ENST00000423025
  CDS Start-End: 92-2137
agttccgaggactggagaggggatagaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctctcctgctgggggcaggcgctggggggctcctggccataggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagcagtcataaactggaggtgaaggtcgggggagactccatgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccgcgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtgaagaggcgtcctgctcgctcttccgcaccgtccttcccggttaataaaatgccctgtacgctt

SEQ ID NO: 125022 - DNA, 1895 bp, Homo sapiens
  Payload ID: 4544
  Gene Symbol: DCST1
  Gene Name: DC-STAMP domain containing 1
  ENST ID: ENST00000525273
  CDS Start-End: 119-1705
gacccagttccgaggactggagaggggatagaaccttgtgtccaaggaggtccttcaggagacctgggatgagtggtgcttccccaaaacagactcatggacattaaacatcatcagaatggcacaagagggcaaagaagaaaacagcctcataccagtttccccagcctctatccacctgcaagccctgaatcctaatgagccccatcccaggcagaagagtgggctgttgagctaccctgtccccctcttagcggtgcagaggctcctgacctgggggctgccagtctcctgtagctggttcctgtggcgccagccgggcgagtttcctgtcactgctctcctgctgggggcaggcgctggggggctcctggccataggtctctttcagctcctggtgaaccccatgaacatctacgaagaacagaagattatgttcttgtacagcttggtgggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagccgcaggcagtcataaactggaggtgaaggtcgggggagactccatgctagcccggcttcttcgaaaaaccattggggccctgaacacctcctcagagacagtgatggaatcaaacaacatgccgagagaagaagcggatcctgttcctctacaatgacctattgaagaaaagagcagccttcaccaaactcaggagggccgctat

SEQ ID NO: 125023 - DNA, 2392 bp, Homo sapiens
  Payload ID: 4545
  Gene Symbol: DCST2
  Gene Name: DC-STAMP domain containing 2
  Uniprot ID: Q5T1A1
  ENST ID: ENST00000368424
  CDS Start-End: 60-2381
ggagcacagaagtcagcgggcatctcctggagacaggcagacatttggtctcagcagccatgcccaaagtcatgaaggatgttgtgcaccccttggggggagaggagcctagcatggcgagagctgtggttcgcagcgtgggaggttttaccctgggcttgtctttagccacggcctacgggcttctggagctactggtggaaggccacagcccctggggttgcctggtgggcaccctcactttggctgccttccttagcctgggcatgggattctctcgccaggtccgagccactgtcctcctgctgctgcctcaggccttctccaggcagggccggacactactgttggtggctgcttttgggttggtgcttcaagggccttgtgccaacactctacgcaacttcacccgggccagcgaggctgtagcctgtggggcagagctggccctgaaccagaccgccgaagtgctacagagggccaagcaacctcttgtcagtgccctgaacaagattaaagctattgcccggaagaccaaagaggtggctgaccgggtccgcaagttctttcggtcaatcatggatggtgtgaaacacatagccagggctctccggaatgtgtggcagtggctcctgcacatcggcgatgtgtgcaactcggaactgggcaacccttacctgaagtgtgcacgggttttcgatgatgccaaggacagctgcatgatggtcataccacaagcctaccacctgtgttacgtgctcatgcccttcaaactggcgctctgtggacttgccagcctggtccaggtgttctgcgtcatccctaagtacattcaacccttcttgcgccagaccatcggcacccccgtgattcagttgctcaaccgggtgcgtcaggagtttgagttcaacatgacagccacccaccacttctctgtggatctcaatgcctctcggagcctgtcccaggtagccatggacctccacgaggctgtcagcatgaagctgcaccgtgtccgagaggccctggctctgatgggcttcaccacgcctctgctgcttgtgcttctctacctccaagccctattttaccggtattgttacctgaactgggaccattatgacaatatctacatcactagccgattcctgcgcatggaggctgtgcgctccacggcagggctgcccacagtgctaccgctcagtgctcacgaggccaggcgctacatcccaccgggctccatcttcttgtcccaatgggagaagtttttttacattctggagaccttcaaccttatccgacacctcctcctcgtgctgttcctagtcttcctagactatgctgtcttctgggtgcttgacctggcccggcaccagctgcagggggagattgtggcccgcagtcctgtgttggtgtctctaaccgtggaaggtactggctacgctgggaatatttatcgtgacctggtgtcagcatttgatgtcctgcagcaaggcaacatcagtattttgtcccggcgttgtctccttcgtccctcggagcctgacagcactggctacatagtcattggcgtcatgtatggcctatgcttcttcatcaccctgtttggcagctatgtcagccggctgcggcgagtcatctgtgcctcctactacccatcccgggagcaggagaggatctcctacctgtacaatgtacttctgagccgccgaaccaatctgttggctgccctgcaccgatcagtgaggcggcgggcggctgaccagggccacagaagtgccttcctagtgctggccagtcggtgcccctgcctaggtccatttgtcagccacttttggctgcatcaggcctactgcctgggctgtgggcagccccaggatgagggagacatggagaacactgtgtcctgcagtacccccggctgccaaggtctctactgcctcacttgcttccgcctcctggacaatacctgctccgtgtgtgcatctcccctctcctaccagggggacctggacctggagctggactccagcgatgaggagggccctcagctatggctggctgcagctcaaaggaaggaccctgagcaggcatggttattgcagcaacagctccaagaagtgctcggcaggagcctctcaatggagtccacttccgagtccagtgacctggatgaggagaaggggcctcagcagaggaagcacgggcagcagcccttacctgaagcccatcagcctgtcagcattctcaccagccctgagccccacagaccacctgagacatcctccgccactaaaggagcccccactccagcttcagaaccctcagtccctctctcacctccctctcttcctgatccttcccacccaccccccaaataaaccaaaagtgg

SEQ ID NO: 125024 - DNA, 2494 bp, Homo sapiens
  Payload ID: 4545
  Gene Symbol: DCST2
  Gene Name: DC-STAMP domain containing 2
  Uniprot ID: Q5T1A1
  ENST ID: ENST00000485982
  CDS Start-End: 81-2000
agaatacggtgagaaattccaggagcacagaagtcagcgggcatctcctggagacaggcagacatttggtctcagcagccatgcccaaagtcatgaaggatgttgtgcaccccttggggggagaggagcctagcatggcgagagctgtggttcgcagcgtgggaggttttaccctgggcttgtctttagccacggcctacgggcttctggagctactggtggaaggccacagcccctggggttgcctggtgggcaccctcactttggctgccttccttagcctgggcatgggattctctcgccaggtccgagccactgtcctcctgctgctgcctcaggccttctccaggcagggccggacactactgttggtggctgcttttgggttggtgcttcaagggccttgtgccaacactctacgcaacttcacccgggccagcgaggctgtagcctgtggggcagagctggccctgaaccagaccgccgaagtgctacagagggccaagcaacctcttgtcagtgccctgaacaagattaaagctattgcccggaagaccaaagaggtggctgaccgggtccgcaagttctttcggtcaatcatggatggtgtgaaacacatagccagggctctccggaatgtgtggcagtggctcctgcacatcggcgatgtgtgcaactcggaactgggcaacccttacctgaagtgtgcacgggttttcgatgatgccaaggacagctgcatgatggtcataccacaagcctaccacctgtgttacgtgctcatgcccttcaaactggcgctctgtggacttgccagcctggtccaggtgttctgcgtcatccctaagtacattcaacccttcttgcgccagaccatcggcacccccgtgattcagttgctcaaccgggtgcgtcaggagtttgagttcaacatgacagccacccaccacttctctgtggatctcaatgcctctcggagcctgtcccaggtagccatggacctccacgaggctgtcagcatgaagctgcaccgtgtccgagaggccctggctctgatgggcttcaccacgcctctgctgcttgtgcttctctacctccaagccctattttaccggtattgttacctgaactgggaccattatgacaatatctacatcactagccgattcctgcgcatggaggctgtgcgctccacggcagggctgcccacagtgctaccgctcagtgctcacgaggccaggcgctacatcccaccgggctccatcttcttgtcccaatgggagaagtttttttacattctggagaccttcaaccttatccgacacctcctcctcgtgctgttcctagtcttcctagactatgctgtcttctgggtgcttgacctggcccggcaccagctgcagggggagattgtggcccgcagtcctgtgttggtgtctctaaccgtggaaggtactggctacgctgggaatatttatcgtgacctggtgtcagcatttgatgtcctgcagcaaggcaacatcagtattttgtcccggcgttgtctccttcgtccctcggagcctgacagcactggctacatagtcattggcgtcatgtatggcctatgcttcttcatcaccctgtttggcagctatgtcagccggctgcggcgagtcatctgtgcctcctactacccatcccgggagcaggagaggatctcctacctgtacaatgtacttctgagccgccgaaccaatctgttggctgccctgcaccgatcagtgaggcggcgggcggctgaccagggccacagaagtgccttcctagtgctggccagtcggtgcccctgcctaggtccatttgtcagccacttttggctgcatcaggcctactgcctgggctgtgggcagccccaggatgagggagacatggagaacactgtgtcctgcagtacccccggctgccaaggatttatatgcaagtggcattgcagcagctccctagtgtgcaccccttgacaaggatggttcatccaggtctctactgcctcacttgcttccgcctcctggacaatacctgctccgtgtgtgcatctcccctctcctaccagggggacctggacctggagctggactccagcgatgaggagggccctcagctatggctggctgcagctcaaaggaaggaccctgagcaggcatggttattgcagcaacagctccaagaagtgctcggcaggagcctctcaatggagtccacttccgagtccagtgacctggatgaggagaaggggcctcagcagaggaagcacgggcagcagcccttacctgaagcccatcagcctgtcagcattctcaccagccctgagccccacagaccacctgagacatcctccgccactaaaggagcccccactccagcttcagaaccctcagtccctctctcacctccctctcttcctgatccttcccacccaccccccaaataaaccaaaagtggacacaagtgtgaa

SEQ ID NO: 125025 - DNA, 587 bp, Homo sapiens
  Payload ID: 4545
  Gene Symbol: DCST2
  Gene Name: DC-STAMP domain containing 2
  ENST ID: ENST00000467991
  CDS Start-End: 1-60
ctccttcgtccctcggagcctgacagcactggctacatagtcattggtgcccctgcctaggtccatttgtcagccacttttggctgcatcaggcctactgcctgggctgtgggcagccccaggatgagggagacatggagaacactgtgtcctgcagtacccccggctgccaaggtctctactgcctcacttgcttccgcctcctggacaatacctgctccgtgtgtgcatctcccctctcctaccagggggacctggacctggagctggactccagcgatgaggagggccctcagctatggctggctgcagctcaaaggaaggaccctgagcaggcatggttattgcagcaacagctccaagaagtgctcggcaggagcctctcaatggagtccacttccgagtccagtgacctggatgaggagaaggggcctcagcagaggaagcacgggcagcagcccttacctgaagcccatcagcctgtcagcattctcaccagccctgagccccacagaccacctgagacatcctccgccactaaaggagcccccactccagcttcagaaccctcagtccctctctcacct

SEQ ID NO: 125026 - DNA, 1222 bp, Homo sapiens
  Payload ID: 4546
  Gene Symbol: DCTPP1
  Gene Name: dCTP pyrophosphatase 1
  Uniprot ID: Q9H773
  ENST ID: ENST00000319285
  CDS Start-End: 96-608
atagagaactcccgtaattggtcggagctctggaggcggggcttcgagcgtggctcgtgggttttccgtgaagtcgcggtgcagcggtgggcggcatgtctgtggccggtggggagattcgtggggacacggggggagaggacactgctgctcccggccggttcagcttcagcccggagcccacgctcgaggacatccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgcccaatagggtcgtgaggtttcaatgagttatgtgaatgctcagggcggggcctggcacatagtaaagtacacttggtaagttt

SEQ ID NO: 125027 - DNA, 853 bp, Homo sapiens
  Payload ID: 4546
  Gene Symbol: DCTPP1
  Gene Name: dCTP pyrophosphatase 1
  ENST ID: ENST00000568434
  CDS Start-End: 385-534
gaattagttgcagaatctcctggtcccaggccccattacatactacgggggtagctgcctctggcccctgcatcaccctctaacccggagacttggacttacactcctttgtcctatttcagccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggca

SEQ ID NO: 125028 - DNA, 801 bp, Homo sapiens
  Payload ID: 4546
  Gene Symbol: DCTPP1
  Gene Name: dCTP pyrophosphatase 1
  ENST ID: ENST00000567983
  CDS Start-End: 51-266
gagcgtggctcgtgggttttccgtgaagtcgcggtgcagcggtgggcggcatgtctgtggccggtggggagattccccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccaggctgtctgggttcaaatgccatctttgacacttgcaagctaaatgacattactcaaattaatcgttctgcacttcagcttccttgtctatcaaataaaaagaatagtacctgcccaa

SEQ ID NO: 125029 - DNA, 878 bp, Homo sapiens
  Payload ID: 4546
  Gene Symbol: DCTPP1
  Gene Name: dCTP pyrophosphatase 1
  ENST ID: ENST00000568973
  CDS Start-End: 475-624
gggaagcgggctggcagcggggctcgggtcctggctctgtgggctgtccctgggtgagccttcttacctcatctgcaaaatgggcgcagcggtgcacacctgaggcaagggaaattgggtggtgcctccgagtggtaactaggaacgcccttcagcctagccctgggaagataccggcaccagataccgcctctgctctccaggcgccggggccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacggg

SEQ ID NO: 125030 - DNA, 749 bp, Homo sapiens
  Payload ID: 4546
  Gene Symbol: DCTPP1
  Gene Name: dCTP pyrophosphatase 1
  ENST ID: ENST00000565758
  CDS Start-End: 401-550
gcggtgggcggcatgtctgtggccggtggggagattcgtggggacacggggggagaggacactgctgctcccggccggttcagcttcagcccggagcccacgctcgaggacatgtaagcaggcctggcccagctcgggccgccgcctccatgctgagtttgctgcggaacgagactgggaacagttccatcagcctcggaatctcctcctggccttggttggggaagtgggggagctggcagaactctttcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataactt

SEQ ID NO: 125031 - DNA, 7393 bp, Homo sapiens
  Payload ID: 4547
  Gene Symbol: DCAF10
  Gene Name: DDB1 and CUL4 associated factor 10
  ENST ID: ENST00000242323
  CDS Start-End: 75-1235
actcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaaattcttctctacccatttgggcttaagacaattcccagaaagtgttttcattatttaaaaaataataatagtaaatgaaagcaattttagaggtggaaaataccttagaatggaatcatttgcattatttgacaaatgagagaagtgacatgacttgcctaaggtcatcctgcaaagttagtggcagagttaggacttgaattccagtcttctaattccttggtcagggcaatttctactgtgttatgctgtctgttagaaataatgacttatggacactttgtctttaagttgtattattgtaaatacccttaaactggccaatagattttagaaaggcaggcatgggagtagatgctgagaattctagccataagaagaaaagtattttaaatcttacagaaatgtttaaacaacccaaaatacatgaataaaaatgacatttctttgtaggacctgccaactaactattcacacacatttatagaggttataaggatcttggctctagaacaaatttttgaaattagatcattttaccatggatgttaacaaaattggaaattttttgtcactgagaaaattatcacaaagcacagtaaatacatatacttaccatacattttgtaaaaaacacattttttaaagaaaatagggatgggtatggtggctcacgtctgtaatcccagcactttgggaggccaaggtgggaggttcacttgagcccaggagttccagaccagtctgggcaacatggcgaaaccccatctctaccaaaaatacaaaaattagatgggcatgttggtacacgcctgtagtcctagctactcaggaggctgaggtgggaggatggtttgagcctgggaggcagaggctgcagtgagccaagattgcactattgcactccaccctgggcaatagagccagatcctgtctcaaaaaataaaaatagactgggcatggtggctcatgcctgtaatcccagcactttgggaggctgaggtgggtggatcacttgaggtcaggagtttgagaacagcctagccaacatggtgaaaccctgtctctaccaaaaatacaaaaatcatagccaagcgtggtggcaggtgcctgtaatcccagctactcaggaggctgaggcaggagactcgcatgaacctgggaggcagaggttgcagtgagccgagatcgcaccactgtactctagcctgaccagcagagcgagactctgcctcaaaaaaaaaaaaaaaaataaaataaaataaaattagttttggaggtgaaaacacccaaactgttattatttaaaaatacctaccaagtactgtggtcatattgacattcaaaagaagtttcataaatcgtatcaactctggaaagagttcatgtcagatgctagaccagcaagttacccaactcaaaattcagccaatgattctttactatagagtacctatcatgtgtcaaataatatacagacttcactactaaccctcacaaaaacttgcagggtaggtggaatgagccccaatttaatttggaggtaatagtgggtcagaaagattaaatgacttgccttaagtcatagagttagcagtgagtggcagcactgggattcaaacccaggtttgtgtcttgtccaaagcctgtgcttactgctttaccattgtgctctttagtttgtaaagtatggtaagctggcctgttatttgtttagtatcttctggattttttttttttaattatagagctagcttaccgtgtgtatcatgtaaaaaaaattcataagattaacaatttccatgagaatatcataaactcagggcacacattctggccattcctgactaaaaaacttcaagcagaataagcagctataaaatagaaaagaaaaattaaggataaacggcattgtgaaaaaaaaccgagccacacagatgagaattaaaaattaacagccagcaaactcaaaagaacctttgtcctccttgagatatggtgatgatcaaaaagttagcaaggaatattaatcaaggaattaaagggcattaggaatgctatagtattggaagaaattacatcttaacatttcaaagccccatttcacttaagagtaaaatctaatctgatgttttttactctgaattttattcagtaatttttattcataattcatgataattggtaatgtagtataattgttagtaaatgcagtacaaattgttctactgttttaaaaagttttccgcagaacagtgcatttatggcaatgctatgtttaatgagttagggacatcaaatatatagtagttccttattttcagttgtgaaaatgaaatggctaaagcagaagagacgtctattttagtcttttaaaaatgtgtgtgggtggtcttttttcctcagaagcccaaagcacatgtatattttgttatttctccttgctatattcctgagactatactaaaaactttaagaaaaggaacaagaaaaaggtaaattcatgtgttccccactgctgtgtctagaaccaagatcacattatatcattgttaaaattgtgttatctagaaagtgcaatatagggaaaacactctaagaatcttttaaaagcctagtgtttcccttatttgtcagaatatgtggtagtggcatccataagtatcttttaacttgcatttagcaggacaaatagtgtgatacttatactgatgacaatcatccccatttaatgaccagcagtcactgagcgctgtgaaaattcactcagtgataccccgtgttggtcttgaaggaaaccgtacatatgaatttttggatagctaatgtatatctctcaagtgccaacatttaaaacttgtaattatttttgatgtgagtatttcaggtatgttagtataccttcctgccttcttcttaaacatcatgctcagtataattcacattttcatgatgaaaagttaaagttatattcataatgtattattataagtatccagctctgatgtatgtaaaacacttcataaaatgtaaagggctataacaaatatgttataaagtgattctctcagccctgaggtatacagaatcatttgcctcagactgctgttggattttaaaatttttaaaatatctgctaagtaatttgctatgtcttctcccacactatcaatatgcctgcttctaacaggctccccactttcttctaatgtgctgttatgagctttggacatgagataaccgtgcctgttcagagtgtctacagtaagagctggacaaactctggggggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagaaaaaagaagagtacaggaaaaaaattcagatagacataagagtattttggatgccattaaactttgtcaataaccattaaaacataggcttaaattatcacgtattgttacaaagacacagttttgtctcattataaaataagattatatgaaatttatattctagaaatgattccaaatcatgtcctaagaatttctcccattcaaatgataatggaaattactgtcaaaaggaaaatctcaaagttaccattacgctgctctcttgtaaatgaactagggataaagatatgggttttatcaaaagccctaaggaatatatctcacattcacctcctatatgtatgtgtatatataaatgccactataaatgaaaatgtcacccagagataataaaataatttttaaagtttaaatctggtccaaagtctttaaaataggtagattttcagctttcttaagtttctccctcatttagatttcatggtttttacataaagggtgaatatttgaattttcttttaaatttcactgcatcttcaattgcccaactgtgtttcctgataaattttagattcacatttttaggaaatttggagtattccagacaatatactagatacccagaaacttttctcagtaggttctgaggtgttttaagttcttatgctagactgtaagctccttgagggcagagactgttttatttattcttgtatcctcagtgcctggtacaggacttgacacagagtagttgttcaataaatatttgttgaatgaatc

SEQ ID NO: 125032 - DNA, 3862 bp, Homo sapiens
  Payload ID: 4547
  Gene Symbol: DCAF10
  Gene Name: DDB1 and CUL4 associated factor 10
  Uniprot ID: Q5QP82
  ENST ID: ENST00000377724
  CDS Start-End: 366-2045
aaagtggagacaccagtacatactcagcctcacaggactgactggtcaggccactcatccccaggcacgcggccaccggtcactgacaactacagaccgactctgccacccagatcaggtgcccagatgctcagtcgctcacacaggtaactactcgctccctacctccgttcccgggactgcggcgccccaaacccggcggtgtctcagctttcccggtccccggcggacggtggccgaggggcggcgcgggtttccagccggtggggttaggccgctgcacgccggaagtggcagctgaacaggggcactgaggtgtcggccggcggggcagtggcccggagcggggggcgggggcgttgatcatgtttccctttgggccccatagccctggaggggacggatcggccggagccggggctgaggagccgacgccccacgaggggcaggcagcagccaccgggccgccctcgccactacatcccggggctgatgcgacccatccccctccacccgcccgaagccctcgccgccccggcgccccatcgctgtccccggccccgcgctccggagagctagggctgcctggagctccggagtcctcaactgcctccgccccgggagagccgtcacctccctcccctccgtgccggcggcccgggccagactgcagggccaagagccggggccgacacggcctcggcgcgggcctgggcggccctggcgctaggctgttcgggtggctgaaagagcgcagcctgggccgcgggctgttcgtggacccggcgcgggacaattttcgcaccatgactagcctctacggttccatccaccccgcggactcggtgtacctcagcacccgcacccacggcgccgtcttcaacctcgagtactcgcccgacgggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctc

SEQ ID NO: 125033 - DNA, 2570 bp, Homo sapiens
  Payload ID: 4548
  Gene Symbol: DCAF11
  Gene Name: DDB1 and CUL4 associated factor 11
  ENST ID: ENST00000326009
  CDS Start-End: 233-448
agtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctg

SEQ ID NO: 125034 - DNA, 2469 bp, Homo sapiens
  Payload ID: 4548
  Gene Symbol: DCAF11
  Gene Name: DDB1 and CUL4 associated factor 11
  Uniprot ID: Q8TEB1
  ENST ID: ENST00000396936
  CDS Start-End: 457-1797
cttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagcttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactcctt

SEQ ID NO: 125035 - DNA, 2402 bp, Homo sapiens
  Payload ID: 4548
  Gene Symbol: DCAF11
  Gene Name: DDB1 and CUL4 associated factor 11
  Uniprot ID: Q8TEB1
  ENST ID: ENST00000396941
  CDS Start-End: 120-1682
agttggtgagctagggtagcgcactacggttcactcttgctttctttgcttcacaggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctg

SEQ ID NO: 125036 - DNA, 4299 bp, Homo sapiens
  Payload ID: 4548
  Gene Symbol: DCAF11
  Gene Name: DDB1 and CUL4 associated factor 11
  Uniprot ID: Q8TEB1
  ENST ID: ENST00000446197
  CDS Start-End: 728-2368
tgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcactctctgtttttcctatctgaggtctttcatctcctcacttcaggaaaacacagttcagcaaagtcttcagatgcgatcctgtgtaggagaaaatacccttctggtgccccatgaaaaagggaaataccaaaaccatttgttcactgagccttgcaataggtgctcccttaccaatttcagaagcttccctgcaagtagatatcgagagagcacactttccattagagcctggtaatacccatatcacctctgctctgaggctgggcctgcagctgtgtagtctttggaagaggtagcccctgaacgcagagcctaagagaagcaagtcggccctgacgccaggccccagtgggcgcctcacactcagaacctcataccccagagcaaaccgatggtcagggagagggctagagctcacacccagctcggaatagatcttccctgatgacatttcatgccctctaaggcagtttttaaatgaaggtacacacatccaggggtgttcacaggctttcacagcaagggtacctatttcatggcaaaataggcagttttaaaagaataaacaagctaggtgtggtggctcatgcctgtaatcctagcactttgggaagccaaagctgatggatcgcttgagcccaggagtttgagaccagcctgggcaacatggcaaaaccccatctctacaaaaaatacaaaaagtaggccgggcacggtggttcacacctgtaatcccggcattttgggaggccgagataggtggatcacctgaagtcaggtgtttgagaccagcctggccaacatggtggaacccaatctctactaaaaatacaaaaaaactagccggatatggtggcgggtgcctgtaatctcagctacttgagaggctgaggcaggagaatcgcttgaacttgggagcagaggtgagctgagtgcagtgagccaagaccatgccattacactcaagcttgggcaacgagagcaaaactctgtctcaaaaaaaaaattagccagatgtggtgacgcatgcctgtagtcctagctactcaggaggctgaggtgggaggatcacctaaggccaggaggtcaaggctgcggtgagccgtgattgtgccaatgtactccagcctaggtgacagagtgagaccctgtctcaaaaataaataataaataaataaatgttca

SEQ ID NO: 125037 - DNA, 2711 bp, Homo sapiens
  Payload ID: 4548
  Gene Symbol: DCAF11
  Gene Name: DDB1 and CUL4 associated factor 11
  Uniprot ID: Q8TEB1
  ENST ID: ENST00000559115
  CDS Start-End: 351-1991
agttcccacttactcctccccagcaagagctaacagccctccttgggtgtgcactttctcctcccctcaggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctg

SEQ ID NO: 125038 - DNA, 575 bp, Homo sapiens
  Payload ID: 4548
  Gene Symbol: DCAF11
  Gene Name: DDB1 and CUL4 associated factor 11
  ENST ID: ENST00000559593
  CDS Start-End: 148-575
agttggtgagctagggtagcgcactacggttcactcttgctttctttgcttcacaggattggagaagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctg

SEQ ID NO: 125039 - DNA, 2342 bp, Homo sapiens
  Payload ID: 4548
  Gene Symbol: DCAF11
  Gene Name: DDB1 and CUL4 associated factor 11
  ENST ID: ENST00000558914
  CDS Start-End: 270-683
agttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctc

SEQ ID NO: 125040 - DNA, 947 bp, Homo sapiens
  Payload ID: 4548
  Gene Symbol: DCAF11
  Gene Name: DDB1 and CUL4 associated factor 11
  ENST ID: ENST00000557810
  CDS Start-End: 581-947
gtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggctta

SEQ ID NO: 125041 - DNA, 1011 bp, Homo sapiens
  Payload ID: 4548
  Gene Symbol: DCAF11
  Gene Name: DDB1 and CUL4 associated factor 11
  ENST ID: ENST00000559144
  CDS Start-End: 1-798
ccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcggtgaggttgcaagggttgagggtgctggcacatgtctggggcttggacttgggtgggggcagcacatcctgactgcttgccaccctctgccctgcagtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcc

SEQ ID NO: 125042 - DNA, 603 bp, Homo sapiens
  Payload ID: 4548
  Gene Symbol: DCAF11
  Gene Name: DDB1 and CUL4 associated factor 11
  ENST ID: ENST00000560901
  CDS Start-End: 168-603
gcgagatgcgtgacgagcgaagcgcgtgacggaggagcggttggccaacgcagtggcggcagtcggtgtaaacaaggcctcgcgccgctgcgggtcctgcgaccgctcctggctggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagcttcttgcccaatgatctgggcttcactgatagctactctcagaaggctttctgtggcatctacagcaaagatggtcaaa

SEQ ID NO: 125043 - DNA, 659 bp, Homo sapiens
  Payload ID: 4548
  Gene Symbol: DCAF11
  Gene Name: DDB1 and CUL4 associated factor 11
  ENST ID: ENST00000559451
  CDS Start-End: 268-438
ttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcaga

SEQ ID NO: 125044 - DNA, 543 bp, Homo sapiens
  Payload ID: 4548
  Gene Symbol: DCAF11
  Gene Name: DDB1 and CUL4 associated factor 11
  ENST ID: ENST00000560713
  CDS Start-End: 196-543
gcgagatgcgtgacgagcgaagcgcgtgacggaggagcggttggccaacgcagtggcggcagtcggtgtaaacaaggcctcgcgccgctgcgggtcctgcgaccgctcctggctgagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctc

SEQ ID NO: 125045 - DNA, 300 bp, Homo sapiens
  Payload ID: 4548
  Gene Symbol: DCAF11
  Gene Name: DDB1 and CUL4 associated factor 11
  ENST ID: ENST00000559396
  CDS Start-End: 210-300
ataagctagtgaagcgctttcttccgagagggatttcgattggtcggtcagagaggttacctggaaatccaacaccgcccaacacccctcccgctccccagtccggggacttcgataggattggagaagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtg

SEQ ID NO: 125046 - DNA, 476 bp, Homo sapiens
  Payload ID: 4548
  Gene Symbol: DCAF11
  Gene Name: DDB1 and CUL4 associated factor 11
  ENST ID: ENST00000559796
  CDS Start-End: 275-476
aggaagccgcgagatgcgtgacgagcgaagcgcgtgacggaggagcggttggccaacgcagtggcggcagtcggtgtaaacaaggcctcgcgccgctgcgggtcctgcgaccgctcctggctgggatttcgattggtcggtcagagaggttacctggaaatccaacaccgcccaacacccctcccgctccccagtccggggacttcgataggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccagaggccaagtgaggttggtgcagggaggaggtgcagcaaatttacaattcattcaggccctcttggactca

SEQ ID NO: 125047 - DNA, 4202 bp, Homo sapiens
  Payload ID: 4548
  Gene Symbol: DCAF11
  Gene Name: DDB1 and CUL4 associated factor 11
  ENST ID: ENST00000557802
  CDS Start-End: 717-932
gcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggtgggtggtctcgcgtggggcggttaccgccggcttcagtgggaggtgcttctcggcttcctccccctcatggcgtacacacccccggcgcaccacgtgggcgtgaggcgaggaaggaggggtgttaggccaaattctattttcattggctgtcactgctgccggcctttgtaagggggcgctctgattggtcgataaggtgggggcgtcgagggtctttgagtcctaaggcttctaattggttagatgagataagctagtgaagcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagcttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaattcaagagcatcaaggcccgcgacgtaggctggagcgtcttggatgtggccttcacccctgatgggaaccacttcctctactctagctggtctgattacattcatatctgcaatatctatggtgagggagatacacacactgccctggatctcaggccagatgagcgtcgctttgctgtcttctccattgctgtctcctcagatggacgagaagtactaggaggggccaatgatggctgcctgtatgtctttgaccgagaacagaaccggcgcacccttcagattgagtcccatgaggatgatgtgaatgcagtggcctttgctgatataagctcccaaatcctgttctctgggggagatgatgccatctgcaaagtgtgggatcgacgcaccatgcgggaggatgaccccaagcctgtgggtgcactggctggacaccaggatggcatcaccttcattgacagcaagggtgatgcccggtatctgatctccaactctaaagaccagaccatcaaactctgggatatccgacgcttttccagccgggaaggcatggaagcttcacgccaggctgccacacagcaaaactgggactatcggtggcagcaagtgcccaaaaaagcctggcggaagctgaagctcccaggggacagctccttgatgacctaccggggccacggagtgctgcacaccctcatccgctgccggttctcccccattcatagcactggccagcagttcatctacagtggctgctccactggcaaagtggttgtgtacgaccttctaagtggccacattgtgaagaagctgaccaaccacaaggcctgtgtgcgtgacgtcagttggcacccctttgaagagaagattgtcagcagttcgtgggacgggaacctgcgtctgtggcagtaccgccaggctgagtacttccaggatgacatgccagaatctgaggaatgtgccagcgcccctgccccagtgccccaatcctctacacccttttcctcaccccagtagatccaacctccagccccatatagggtgaacctcttgataagctctctgcctcctcctccctttctcccttgtggggaatgtttggaggaatcactggcatttgatggggaataacataagcctgggctctgagcctcagctgagccctggaagattctccccatggggcagagtggtctccttacgtgctcacacccagtcagcttgggtccctatctctggccagagtttggcaggactgccattatctggggtgtggcctctgccagcaagagaagtgtcctgggtgtttttaatcatgtttgaatgttaggggttggatcctagagtagatgcctgaggccacatctgaacagacctgtcagccaggcctgccaggtcttcacgttgaggattcaactggccaatcacaggacaggtgtcctggcctttcttcctgaggtctctaggggaggggcatgggtaagggtgtttcctcagcaccctcctggggtggggattatgtctgctgtcatgtctgggtctttagggtaggacaggctgtggtatgagaggcaggagtctccacaaggcttcatgtggccccttatagggcaggccctgccctctgggaaggtcccttcatgctggaggcacacagctttaaggaagtaggttgaagtaggactccttcgtcctctcactggctttggctccctcaataaactgtgtgggaacctggctcagtgtctgtctctctctctcactctctgtttttcctatctgaggtctttcatctcctcacttcaggaaaacacagttcagcaaagtcttcagatgcgatcctgtgtaggagaaaatacccttctggtgccccatgaaaaagggaaataccaaaaccatttgttcactgagccttgcaataggtgctcccttaccaatttcagaagcttccctgcaagtagatatcgagagagcacactttccattagagcctggtaatacccatatcacctctgctctgaggctgggcctgcagctgtgtagtctttggaagaggtagcccctgaacgcagagcctaagagaagcaagtcggccctgacgccaggccccagtgggcgcctcacactcagaacctcataccccagagcaaaccgatggtcagggagagggctagagctcacacccagctcggaatagatcttccctgatgacatttcatgccctctaaggcagtttttaaatgaaggtacacacatccaggggtgttcacaggctttcacagcaagggtacctatttcatggcaaaataggcagttttaaaagaataaacaagctaggtgtggtggctcatgcctgtaatcctagcactttgggaagccaaagctgatggatcgcttgagcccaggagtttgagaccagcctgggcaacatggcaaaaccccatctctacaaaaaatacaaaaagtaggccgggcacggtggttcacacctgtaatcccggcattttgggaggccgagataggtggatcacctgaagtcaggtgtttgagaccagcctggccaacatggtggaacccaatctctactaaaaatacaaaaaaactagccggatatggtggcgggtgcctgtaatctcagctacttgagaggctgaggcaggagaatcgcttgaacttgggagcagaggtgagctgagtgcagtgagccaagaccatgccattacactcaagcttgggcaacgagagcaaaactctgtctcaaaaaaaaaattagccagatgtggtgacgcatgcctgtagtcctagctactcaggaggctgaggtgggaggatcacctaaggccaggaggtcaaggctgcggtgagccgtgattgtgccaatgtactccagcctaggtgacagagtgagaccctgtctcaaaaataaataataaataaataaatgttcaga

SEQ ID NO: 125048 - DNA, 849 bp, Homo sapiens
  Payload ID: 4548
  Gene Symbol: DCAF11
  Gene Name: DDB1 and CUL4 associated factor 11
  ENST ID: ENST00000559017
  CDS Start-End: 526-849
gaaagacgcgtgtattagggaacgtctgcaaagaccgcggcggaaagccagggattgtcttaaaaaattgtcagaccggataaagggaggtctaaaaggggaccgtcccaagagcaaggcttccaaaagctaagcccggaaggacggcacctcgcgcattctcccgcctacctatcaatcatcgtgctccgctgtccagttggctggccaagggggcggggccgtcgtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctgggatttcgattggtcggtcagagaggttacctggaaatccaacaccgcccaacacccctcccgctccccagtccggggacttcgataggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgag

SEQ ID NO: 125049 - DNA, 581 bp, Homo sapiens
  Payload ID: 4548
  Gene Symbol: DCAF11
  Gene Name: DDB1 and CUL4 associated factor 11
  ENST ID: ENST00000558638
  CDS Start-End: 133-581
agagaggttacctggaaatccaacaccgcccaacacccctcccgctccccagtccggggacttcgataggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggcttt

SEQ ID NO: 125050 - DNA, 552 bp, Homo sapiens
  Payload ID: 4548
  Gene Symbol: DCAF11
  Gene Name: DDB1 and CUL4 associated factor 11
  ENST ID: ENST00000557888
  CDS Start-End: 131-346
aatctttcttcagttggtgagctagggtagcgcactacggttcactcttgctttctttgcttcacaggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttct

SEQ ID NO: 125051 - DNA, 549 bp, Homo sapiens
  Payload ID: 4548
  Gene Symbol: DCAF11
  Gene Name: DDB1 and CUL4 associated factor 11
  ENST ID: ENST00000559382
  CDS Start-End: 194-549
gagatgcgtgacgagcgaagcgcgtgacggaggagcggttggccaacgcagtggcggcagtcggtgtaaacaaggcctcgcgccgctgcgggtcctgcgaccgctcctggctgagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccag

SEQ ID NO: 125052 - DNA, 547 bp, Homo sapiens
  Payload ID: 4548
  Gene Symbol: DCAF11
  Gene Name: DDB1 and CUL4 associated factor 11
  ENST ID: ENST00000560614
  CDS Start-End: 138-308
tttcgattggtcggtcagagaggttacctggaaatccaacaccgcccaacacccctcccgctccccagtccggggacttcgataggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatct

SEQ ID NO: 125053 - DNA, 545 bp, Homo sapiens
  Payload ID: 4548
  Gene Symbol: DCAF11
  Gene Name: DDB1 and CUL4 associated factor 11
  ENST ID: ENST00000561001
  CDS Start-End: 162-545
agtggcggcagtcggtgtaaacaaggcctcgcgccgctgcgggtcctgcgaccgctcctggctggtgggtggtctcgcgtggggcggttaccgccggcttcagtgggaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtct

SEQ ID NO: 125054 - DNA, 641 bp, Homo sapiens
  Payload ID: 4548
  Gene Symbol: DCAF11
  Gene Name: DDB1 and CUL4 associated factor 11
  ENST ID: ENST00000558706
  CDS Start-End: 320-490
agcgctttcttccgagagggatttcgattggtcggtcagagaggttacctggaaatccaacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctccctt

SEQ ID NO: 125055 - DNA, 592 bp, Homo sapiens
  Payload ID: 4548
  Gene Symbol: DCAF11
  Gene Name: DDB1 and CUL4 associated factor 11
  ENST ID: ENST00000558408
  CDS Start-End: 313-592
gacttcgataggtgagtttggtgtagaaaacaaatctttcttcagttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccac

SEQ ID NO: 125056 - DNA, 578 bp, Homo sapiens
  Payload ID: 4548
  Gene Symbol: DCAF11
  Gene Name: DDB1 and CUL4 associated factor 11
  ENST ID: ENST00000560457
  CDS Start-End: 172-387
gaagcgctttcttccgagagggatttcgattggtcggtcagagaggttacctggaaatccaacaccgcccaacacccctcccgctccccagtccggggacttcgataggattggagaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgcc

SEQ ID NO: 125057 - DNA, 587 bp, Homo sapiens
  Payload ID: 4548
  Gene Symbol: DCAF11
  Gene Name: DDB1 and CUL4 associated factor 11
  ENST ID: ENST00000560459
  CDS Start-End: 270-587
agttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcggg

SEQ ID NO: 125058 - DNA, 547 bp, Homo sapiens
  Payload ID: 4548
  Gene Symbol: DCAF11
  Gene Name: DDB1 and CUL4 associated factor 11
  ENST ID: ENST00000559354
  CDS Start-End: 278-547
ctttcttcagttggtgagctagggtagcgcactacggttcactcttgctttctttgcttcacaggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggcc

SEQ ID NO: 125059 - DNA, 748 bp, Homo sapiens
  Payload ID: 4548
  Gene Symbol: DCAF11
  Gene Name: DDB1 and CUL4 associated factor 11
  ENST ID: ENST00000561375
  CDS Start-End: 201-748
gtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtctcgagtgatatctcacttcttgcccaatgatctgggcttcactgatagctactctcagaaggctttctgtggcatctacagcaaagatggtcaaatattcatgtctgcttgccaagaccagacaatccgactctatgactgccgatatggccgtttccgtaaatt

SEQ ID NO: 125060 - DNA, 581 bp, Homo sapiens
  Payload ID: 4548
  Gene Symbol: DCAF11
  Gene Name: DDB1 and CUL4 associated factor 11
  ENST ID: ENST00000558215
  CDS Start-End: 362-581
gtgtgacgtttgcagcccgccggccaggaagccgcgagatgcgtgacgagcgaagcgcgtgacggaggagcggttggccaacgcagtggcggcagtcggtgtaaacaaggcctcgcgccgctgcgggtcctgcgaccgctcctggctggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttgg

SEQ ID NO: 125061 - DNA, 570 bp, Homo sapiens
  Payload ID: 4548
  Gene Symbol: DCAF11
  Gene Name: DDB1 and CUL4 associated factor 11
  ENST ID: ENST00000561041
  CDS Start-End: 109-570
ggaaatccaacaccgcccaacacccctcccgctccccagtccggggacttcgataggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttaggcgggccgcccagaagcacagctttcctcgaatgttgcaccagagagaacggggcctctgccatcggggaagcttctcccttggagaacagtct

SEQ ID NO: 125062 - DNA, 575 bp, Homo sapiens
  Payload ID: 4548
  Gene Symbol: DCAF11
  Gene Name: DDB1 and CUL4 associated factor 11
  ENST ID: ENST00000559288
  CDS Start-End: 262-575
aacaccgcccaacacccctcccgctccccagtccggggacttcgataggattggagaaggtttgtgttcccgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccgggtccggagacccctccgagggcttgccccgaagaggggctggcctgcgtcggagtgaggaagaggaagaagaggatgaagatgtggatctggcccaggtactggcctatctcctccgcaggccctcttggactcagaggaagagaatgacagagcttgggatggtcgtcttggggatcgatacaacccacctgtggatgctacccctgacacccgggagctggaattcaatgagatcaagacacaagtggaactggccacagggcagctggggcttagg

SEQ ID NO: 125063 - DNA, 3667 bp, Homo sapiens
  Payload ID: 4549
  Gene Symbol: DCAF12
  Gene Name: DDB1 and CUL4 associated factor 12
  Uniprot ID: Q5T6F0
  ENST ID: ENST00000361264
  CDS Start-End: 343-1704
tttccgtggcgacgctatccgaagtgcggctgcgcaagggtgacggcgcgcgagcaagggggagggggtgttttggttctagccgctcgccgtccttgcaggctctgccgtcggaaagccgctcattctcgcttccccttccctttcccggctcaagtccttcctctctctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactatggcccggaaagtagttagcaggaagcggaaagcgcccgcctcgccgggagctgggagcgacgctcagggcccgcagtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaagaagacacaaaccctgacaactgcaaggttcgggctctggccttcaacaacaagaacaaggaactgggagcagtgtctctggatggctactttcatctctggaaggctgaaaatacactatctaagctcctctccaccaaactgccatattgccgtgagaatgtgtgtctggcttatggtagtgaatggtcagtttatgcagtgggctcccaagctcatgtctccttcttggatccacggcagccatcatacaacgtcaagtctgtctgttccagggagcgaggcagtggaatccggtcagtgagtttctacgagcacatcatcactgtgggaacagggcagggctccctgctgttctatgacatccgagctcagagatttctggaagagaggctctcagcttgttatgggtccaagcccagactagcaggggagaatctgaaactaaccactggcaaaggctggctgaatcatgatgaaacctggaggaattacttttcagacattgacttcttccccaatgctgtttacacccactgctacgactcgtctggaacgaaactctttgtggcaggaggtcccctcccttcagggctccatggaaactatgctgggctctggagttaatgacaactccccaaatgcagagatttacactaacttccattctcagtttccttgtttcttttgattttttttttcctaattgtgtgaggctcttgtgttttagtgggaacaccaaagtttgcctatagtttaggcacttaataggaagaagctctgtacagaaatctgaaagttgttttgctttttgttttcccctttggtaatcaaaattttactatcttttattatttctggcttttcaaccaaacattgttgctaatccctatttttctttaagtgacacacattctcctgtctctggcttcttcaggctgaaatgacatagctcacccttacttcactcttgagaggtagggctcctttataattacatggttgctctcagactttctgtgaaagtttgggagctgtgtgtgtctgtgtgtgtgtgagagagagatcttgtctgcgtgtgtgtgtgtgatcttgtgtgcctgtaggtactgtgtgtcactgaaattacctggagtgaggattacttgtaattaaaatatttataaaagaaacaactttattcacagagtccagctttgggactagtctgtatcttgttttttaagtctaacaacactgataataggaagtaaaaacagaaaggaaaagaaattaccactgggaaaatctttttagttagattgtaggcttcctggggcctcccatgccaggactgcaaagtgatccagccctacctgtcttcccacctgtgtgtcccccgtgtgggaagttggtgtcacttccccttcccaccctcacatctgcttagccagtagccacacccctaaaacatcagactcaccatccaggtgcagctccagaggctacaaaaggcttcatgggacttgaatccccatcctagcttctctctccttcccctcaagacctgatctggttttaaggggcctggagctgggagtctcaagtctgctaagattcacatccatagcccccatggctttgaggagaatcctctctgccattcttccaatctccccagtgggttttgctattattttctaaattgggttaagtctaagaaggtgggggtgagcagggggtttatctgtgtgtagtgagtgcttcatgtgtggaatattcattttcttactgcagtgggacttggggttgaagccacccctcctactctgttggcttagccctgagatggtgacaggctggcctgcagtcagcatcattgtgcatgtgacagcatcaatgtgattagtaatttgtctgttcctcccttgaactgtctgtttagtctgaggtttttaaacttgcaggcagctgactgtgatgtccacttgttccctgatttttacacatcatgtcaaagataacagctgttcccacccaccagttcctctaagcacatactctgcttttctgtcaacatcccattttggggaaaggaaaagtcatatttattcctgcaccccagttttttaacttgttctcccagttgtccccctcttctctgggtgtaagaagggaaattggaaaaaaaattatatatatattctccttttaatggtggggggctactggagaggagagacagcaagtccaccctaacttgttacacagcacataccacaggttctggaattctcatcttcgaacctagagaaataggtgctataaacagggaattaagcaaaatgctggatgctatagatcttttaattgtcttaattttttttctattattaaactacaggctgtagatttcttagttctcacagaacttctatcattttaaactgacttgtatatttaaaaaaaaaatcttcagtaggatgttttgtactattgctagaccctcttctgtaatgggtaatgcgtttgattgtttgagattttctgtttttaaaaatgtagcacttgactttttgccaaggaaaaaaataaaaattattccagtgca

SEQ ID NO: 125064 - DNA, 803 bp, Homo sapiens
  Payload ID: 4549
  Gene Symbol: DCAF12
  Gene Name: DDB1 and CUL4 associated factor 12
  ENST ID: ENST00000396990
  CDS Start-End: 123-803
tggaaatctaaagggaatggtgaagttgcaccgtaaggggaaggtgactgaggagctgaaactgactgaggggctgaagcatttcggacaggagaaaggatcaggaggagacagagcggagaatggagcctcagggctacccagcgtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctgggaggtgacagatgatgttttgaccaaaagtgatgcgagacacaatgtgtcacgggtccctgtgtatgcacacatcactcacaaggccttaaaggacatccccaaa

SEQ ID NO: 125065 - DNA, 676 bp, Homo sapiens
  Payload ID: 4549
  Gene Symbol: DCAF12
  Gene Name: DDB1 and CUL4 associated factor 12
  ENST ID: ENST00000450964
  CDS Start-End: 109-676
tgatgatgcatccctggaagacctgggagccaggtctggctccttggactgtatcttccgtgctccagtgggagtacagactgagagggagaagggggctgggtagagatgcagcccatgtcgtttggctgggatcactcgcttcacaaaaggaaaagacttcctcctgtgaagagatccttagtatactacttgaagaaccgggaagtcaggctacagaatgaaaccagctactctcgagtgttgcatggttatgcagcacagcaacttcccagtctcctgaaggagagagagtttcaccttgggacccttaataaagtgtttgcatctcagtggttgaatcataggcaagtggtgtgtggcacaaaatgcaacacgctatttgtcgtagatgtccagacaagccagatcaccaagatccccattctgaaagaccgggagcctggaggtgtgacccagcagggctgtggtatccatgccatcgagctgaatccttctagaacactgctagccactggaggagacaaccccaacagtcttgccatctatcgactacctacgctggatcctgtgtgtgtaggagatgatggacacaaggactggatcttttccatcgcatggatcagcgacactatggcagtgtctggctcacgtgatggttctatgggactctggg

SEQ ID NO: 125066 - DNA, 3382 bp, Homo sapiens
  Payload ID: 4550
  Gene Symbol: DCAF12L1
  Gene Name: DDB1 and CUL4 associated factor 12-like 1
  Uniprot ID: Q5VU92
  ENST ID: ENST00000371126
  CDS Start-End: 244-1635
tctcgccgcacgctgactttgctctcactgcccggccagacgcacttcccgccttcgcctaggtctgcaccgccaccgccgccctctcccgcgcgtccctcacccggtccgccactgccgcgcctcagaatccgaaggctcggttccagcgcagccatccacgccgccgccacgaccgactccggagccacgcgctgcaaccgccaccaacgccttgccgccgccgctcgcccgccgcccaccatggcccagcagcaaacaggtagcaggaaacggaaagcgcccgcggtcgaggcggacgccgagagctcgccgtcgcagggcttggcggcagcggacggtgaggggccgctgctactcaagaggcagaggcggccggcgacgtatcgctcgatggcgcactatctgaaggttcgggaggtaggcgggtggggccccgccaggctccagggcttcgatggcgagctgcggggctacgcggtacagaggctgcccgagctgctgacggagcgccaactggagctgggcacggtcaacaaggtgttcgcgtcacagtggctgaactccaggcaggtggtgtgcggcaccaagtgtaacacgcttttcgtggtggacgtggagtcaggccacatcgcgcgcattcccctcttgcgggacagtgaggccaggctggcccaggaccaacagggctgcggcatccatgccatcgagctgaatccctccaagacgcttctggccaccggcggcgaaaaccccaacagcctggccatctaccagctgccctccctggatcccctgtgcctgggcgaccgccatggccacaaggactggatcttcgccgtcgcctggctgagtgacaccgtagccgtgagcggctcccgcgacggcactgtggcgctgtggcggatggacccggacaagttcgatgacactgttgcctggcatagcgaggtgggtctccccgtatatgcccacatccgtccgagggatgtggaggccatccccagggccatcatcaaccccagtaaccgcaaggtgcgggccctggcctgcggcggcaagaaccaggaactgggagcggtgtccttggacggctacttccacctgtggaaagccgggagcgcactatccaggctgctgtccatcaggctgccctacttccgggataatgtgtgcctgacctactgtgatgatatgtctgtgtacgccgtgggctcccattcccacgtctctttcctggatctgcgccaggaccagcagaacatccggcccctgtgttctcgagagggtggcacaggcgtgcggtcgctgagcttctaccgccacatcatcactgtgggcaccggtcagggctccctgctcttctatgacgtccgggcccagaaattcctggaggaaagagcctccgccaccctggagtcctcttcgggacctgcaaggaggaagctcaggcttgcctgtggcagaggctggctcaaccacaatgatttctgggtgaattactttggtggcatggaagtgtttcccaatgcgctctacacccactgctacaactggcctgagatgaagctctttgtggctggggggcctctccctgcaggcctccatgggaactatgcaggcctctggagctaaggatgaccgccttgtactccaggtggaaccagcccagcttaatttgtactcctccaagcagagagagtgagtggtcctttggtcaatgaaaacttggctttaagactttttgactcctttccaacaccatcttttggaattttcatacaaagaaatttggttaatcgttaatctttagttgcattctctctttgagtgattcatacattctgtttctttaagaagatgcagtcatggtctttcagttatgtatatttgttttccttgtttttcctcgttaccaatattacaacagcattgttttcagttatttttcattgcagatacgaagagaaaattttctagtaagcaaggtgttcctacatcttttctggagagcttaccatagttttatagcattgttcaattggaaaagtacattccaagttctagattacctacgtttggaaacacttaatttacaaattgtgatcttagtgtatatagtttttacgttgttggtgctaaagtgcttttttgaagtttattctctttcaaaataagttatcatagaatcttgtgcttgtatcaaactcctaattggtcggaacactttaggagtgcaggggttctgcttcattgcattttcagaattaacctgaaagttgaaacaaccatttttttttatttcaaaacttatttaagttgttatcacctgtccttaaatagataaaagaatgtgtattttttcacttgttgccttagtactatcaagacttgtgaatatatttgaatgtatgttgtttgaaaaacttgcacagggcattggagccatcatgaaaagcaggaaatgtaaacgtggaatgtatggcaggctgggcagaatgtatactgatccagggtatagactagatatttttgctgttgctgtttttattataaaatgttatatttgaggatatttaacattttccaattctgcttaagaggtaattcacaataaaaaaaacaaagaccaaaaatagcacattctgaaaaaaagattcttaataagattttattttgtgaagttcaaagattctttcctaaagtataacgtgttgttaaaaagtagtggtgttataactctcaatgtaatagtatgcaatatcaagaacacaggaagttcgtttcaagataggtgagatttaaaataaataggatgaggttgaagaaaagtatattggagcgcagataaatataaattgtggactgctatgaaaacaggttgtacttctccatatgtgagactactggaagtgagaagcaatatttgtcatttctaaaactggccaggctgtgctgacccaggattagtaatttgttatgtctgttttcccttagatgtttgggcactcagatgctatcttggtgcacacacacaacattgctgttcagtcacaaatccgaacaacttaatataataaattgtactaaaagtcatttaagaaataccaaaaagtaagcttttgtttctaaccattgttataaaggctaatataattgttgttatatagcagtaagatatatttgtgtgcatgcgtctccaagtcagttgtaaatgtcttgagaacagagaatacaattgtcatctttatattgcctcatttctccactaatacttagcaaataaaaggcaataagtaaatatgtactggttgaatgcctctggagacctagagtttaaagttttaagtcaataaataaataaatatttactcttaaataa

SEQ ID NO: 125067 - DNA, 1421 bp, Homo sapiens
  Payload ID: 4551
  Gene Symbol: DCAF12L2
  Gene Name: DDB1 and CUL4 associated factor 12-like 2
  Uniprot ID: Q5VW00
  ENST ID: ENST00000360028
  CDS Start-End: 28-1419
gctgctgcagatcgcccgccgcccaccatggcccagcagcaaacaggtagcaggaaacggaaagcgcccgcggtcgaggcgggagccgggagctcgtcgtcgcagggtttagcggcggcggacggagaggggcctctgctacccaagaagcagaagcggccggcgacgcgtcgcaggctggtgcactatctgaagggccgggaggtaggagcgcggggcccagccgggctccagggcttcgagggcgagctgcggggctacgccgtccagaggctgcccgagctgctgacggagcgccagctggacctgggcaccctcaacaaggtgttcgcgtcacagtggctgaacgccaggcaggtggtgtgcggcaccaagtgtaatacgctgtttgtggtggacgtgcagtcaggccacatcacgcgcatccccctcatgcgggacaaggaggccgggctggcccaggcccaccagggctgcggcatccatgccatcgagctgaatccctccaagacgcttctggccaccggcggcgaaaaccccaacagcctggccatctaccagctgcccaccctggaccccctgtgcctgggcgaccgccatggccacaaggactggatcttcgcagtcgcctggctgagtgacaccgtagctgtgagcggctcccgcgacggcaccgtggctctgtggcggatggacccagacatgtttaatggcagcattgcctggcacagcgaggtgggtctcccagtatatgcccacatccgtccgagggatgtggaggccatccccagggccagcaccaaccccagcaaccgcaaggtacgggccctggccttcagcggcaagaaccaggagctgggagcggtgtccttggacggctacttccacctgtggaaagcccggagcacactatccaggctcctgtccatcaggctgccctactgccgagagaatgtgtgcctgacctactgtgatgagttgtccctgtacgctgtgggctctcagtcccacgtctccttcctggatccgcgccagcgccagcagaacatccggcccctgtgctctcgagagggtggcacaggcgtgcggtcgctgagcttctaccagcacatcatcactgtgggcaccggccatggttccctgctcttctatgacatccgcgcccagaagttcctggaggagagggcctcttccagcctggactccatgccggggcccgcagggaggaagctcaagcttgcctgcggcagaggctggctcaaccaagatgacgtctgggtgaactactttggtggcatgggagagttccccaatgcgctctacacccactgctacaactggccggagatgaagctctttgtggctggggggcctctcccttcaggcctccatgggaactacgcaggcctctggagttaagg

SEQ ID NO: 125068 - DNA, 2642 bp, Homo sapiens
  Payload ID: 4552
  Gene Symbol: DCAF13
  Gene Name: DDB1 and CUL4 associated factor 13
  ENST ID: ENST00000297579
  CDS Start-End: 278-2071
aaaagacggaggagatccagttcgggctgacagtgagaggatgcagcccggtgtctgggcgggctcttaccggcgaagcggatcttcacgaggtcgagcggatgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgatgcagtggccgccaccgtggcgacggtcgccccttgtgagcgcaaccccacctccgggaccaacgagaggactcttatgcccaaggcgcgtgagcgaagccggagactctagtactgagggggcaagaacggggcacagacactacgtcacgccggcggaaagcgcgatggaggggaggtcccagcctctcccgagtctccgccctgcctcgcccacaaatgctccagcccacggacgcggaagcgactgcacagctaaagaaccgccccttgctaacgtttgccggcaaaactacggagcggcgcaggatccagttgagccagcaggccgccgctccgcgagtcacgtgactggaagtagtctgggaaaagcggaagtcgcctgtgggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactgttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattgaaa

SEQ ID NO: 125069 - DNA, 837 bp, Homo sapiens
  Payload ID: 4552
  Gene Symbol: DCAF13
  Gene Name: DDB1 and CUL4 associated factor 13
  ENST ID: ENST00000519682
  CDS Start-End: 36-701
acacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactgttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgaggtaatgtttttttttaagtatgttttacttattatggcttaataatttcagttctgtttagaaaacttttgaatgtatgatagaaacttctgaattttaatggtgttttggcattttgtcagttttcccgattgtaaatgagttctgatacctttgctcaaatcccaacatgtttccc

SEQ ID NO: 125070 - DNA, 2049 bp, Homo sapiens
  Payload ID: 4552
  Gene Symbol: DCAF13
  Gene Name: DDB1 and CUL4 associated factor 13
  ENST ID: ENST00000521971
  CDS Start-End: 69-626
ggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgaggtaatgtttttttttaagtatgttttacttattatggcttaataatttcagttctgtttagaaaacttttgaatgtatgatagaaacttctgaattttaatggtgttttggcattttgtcagttttcccgattgtaaatgagttctgatacctttgctcaaatcccaacatgtttcccagcagtttagtcccagatactagagttaagcattgttagaggagtggtgtgtgcatttgcccattggggtaaaatccaagtaaatatagtcttgttttaactttagttttactcatgccttcaacttcatgttccatagattatgtcattgtacatttaggaaaatgttaatttttctacctgccttggaggtcagaagaaggagcattggacatcattttgtctatttgtaattggtaaggtaccaatgcttcataaaaacatttgtgattattgttgaactgcatggtaattagttatagttatatttttctttgctcagaagtctgaattgtgattcccagttcctccaggcctaagggaagagttggagattggccactacatgtcgtctgtttaggtctgaatttaggaatggaggctgtcctgaaggctaagctagcccttggactccagatctttctctgaactttttcttaatgcataacaatagatgaactgattgtccagaagactcagtagggatatgtttttcctgttgaaagaaaaggcaatcatagcatatataagccaattttagcagttattgcgaggctaccattttaggtagtatgagagaaaaatcctaatatgcaagtgttatgctcttaaagacccaacctgataaaagataggaagtaaggttgagtcaaaatagtaaggtataaaaatagtttgtatgatatactggaaaatgagatgctgcagtgcgatgtgagcttggccttgaggaattactgagaagtcagaggacactcttcctgcaactaccacatgctcacacacacactttctagagacgctacaggtctagaataggttggcaaactagtctgtgagccacatgtggcccactgcctgtttttgtaaatagagctctgctagaagacagccatgttctcttgcgtacatattgtctgtagctgctttcgtgctatgatggcagagttaagtaattgccacagagaccatatggcccacaaaacctaaaatacttactctctggccctttacagaaaaagttttctgattcctggtctggagtgtctgtctctattatatctttctcactccatcctccatcttccttccttatgtttcccttggttgtagaagagagaagtggcatggaaaggcagctacctttgcagagcaggaccaagtgtaaaagttgataacatatgtgaacattttttaaaagtgctatccaaattcaagatggtgacggtattacgtactaaaaaaaaa

SEQ ID NO: 125071 - DNA, 2639 bp, Homo sapiens
  Payload ID: 4552
  Gene Symbol: DCAF13
  Gene Name: DDB1 and CUL4 associated factor 13
  ENST ID: ENST00000616836
  CDS Start-End: 278-2071
aaaagacggaggagatccagttcgggctgacagtgagaggatgcagcccggtgtctgggcgggctcttaccggcgaagcggatcttcacgaggtcgagcggatgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgatgcagtggccgccaccgtggcgacggtcgccccttgtgagcgcaaccccacctccgggaccaacgagaggactcttatgcccaaggcgcgtgagcgaagccggagactctagtactgagggggcaagaacggggcacagacactacgtcacgccggcggaaagcgcgatggaggggaggtcccagcctctcccgagtctccgccctgcctcgcccacaaatgctccagcccacggacgcggaagcgactgcacagctaaagaaccgccccttgctaacgtttgccggcaaaactacggagcggcgcaggatccagttgagccagcaggccgccgctccgcgagtcacgtgactggaagtagtctgggaaaagcggaagtcgcctgtgggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactgttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattg

SEQ ID NO: 125072 - DNA, 2038 bp, Homo sapiens
  Payload ID: 4552
  Gene Symbol: DCAF13
  Gene Name: DDB1 and CUL4 associated factor 13
  Uniprot ID: Q9NV06
  ENST ID: ENST00000618975
  CDS Start-End: 69-359
ggaggaggtggcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagagttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgaggtaatgtttttttttaagtatgttttacttattatggcttaataatttcagttctgtttagaaaacttttgaatgtatgatagaaacttctgaattttaatggtgttttggcattttgtcagttttcccgattgtaaatgagttctgatacctttgctcaaatcccaacatgtttcccagcagtttagtcccagatactagagttaagcattgttagaggagtggtgtgtgcatttgcccattggggtaaaatccaagtaaatatagtcttgttttaactttagttttactcatgccttcaacttcatgttccatagattatgtcattgtacatttaggaaaatgttaatttttctacctgccttggaggtcagaagaaggagcattggacatcattttgtctatttgtaattggtaaggtaccaatgcttcataaaaacatttgtgattattgttgaactgcatggtaattagttatagttatatttttctttgctcagaagtctgaattgtgattcccagttcctccaggcctaagggaagagttggagattggccactacatgtcgtctgtttaggtctgaatttaggaatggaggctgtcctgaaggctaagctagcccttggactccagatctttctctgaactttttcttaatgcataacaatagatgaactgattgtccagaagactcagtagggatatgtttttcctgttgaaagaaaaggcaatcatagcatatataagccaattttagcagttattgcgaggctaccattttaggtagtatgagagaaaaatcctaatatgcaagtgttatgctcttaaagacccaacctgataaaagataggaagtaaggttgagtcaaaatagtaaggtataaaaatagtttgtatgatatactggaaaatgagatgctgcagtgcgatgtgagcttggccttgaggaattactgagaagtcagaggacactcttcctgcaactaccacatgctcacacacacactttctagagacgctacaggtctagaataggttggcaaactagtctgtgagccacatgtggcccactgcctgtttttgtaaatagagctctgctagaagacagccatgttctcttgcgtacatattgtctgtagctgctttcgtgctatgatggcagagttaagtaattgccacagagaccatatggcccacaaaacctaaaatacttactctctggccctttacagaaaaagttttctgattcctggtctggagtgtctgtctctattatatctttctcactccatcctccatcttccttccttatgtttcccttggttgtagaagagagaagtggcatggaaaggcagctacctttgcagagcaggaccaagtgtaaaagttgataacatatgtgaacattttttaaaagtgctatccaaattcaagatggtgacggtattacgtac

SEQ ID NO: 125073 - DNA, 779 bp, Homo sapiens
  Payload ID: 4552
  Gene Symbol: DCAF13
  Gene Name: DDB1 and CUL4 associated factor 13
  ENST ID: ENST00000521999
  CDS Start-End: 166-779
ggtggcggtgggcggaactcctagcggacacctcgtggagtccggccggaagagcaaccgagatgaaggtgaagatgctgagccggaatccggacaattatgtccgcgaaaccaagttggacttacagagaggttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtg

SEQ ID NO: 125074 - DNA, 1967 bp, Homo sapiens
  Payload ID: 4552
  Gene Symbol: DCAF13
  Gene Name: DDB1 and CUL4 associated factor 13
  Uniprot ID: Q9NV06
  ENST ID: ENST00000612750
  CDS Start-End: 59-1396
gcggtgggcggaactcctagcggacacctcgtggagtccggccggaagagcaaccgagatgaaggtgaagatgctgagccggaatccggacaattatgtccgcgaaaccaagttggacttacagagagttccaagaaactatgatcctgctttacatccttttgaggtcccacgagaatatataagagctttaaatgctaccaaactggaacgagtatttgcaaaaccattccttgcttcgctggatggtcaccgtgatggagtcaattgcttggcaaagcatccagagaagctggctactgtcctttctggggcgtgtgatggagaggttagaatttggaatctaactcagcggaattgtatccgtacaatacaagcacatgaaggctttgtacgaggaatatgtactcgcttttgtgggacttcttttttcactgttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagattataacttatatacttttgatatgcgtgcactggacactcctgtaatggtccatatggatcatgtatctgcagtgcttgatgtggattactctcccactgggaaggagtttgtgtctgctagtttcgataaatctattcgaatctttcctgtagacaaaagtcgaagcagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacattttagttatatgtgtagagctttattgttactccttttagctaccctgaaaaatgatccttaaaggtggcctagttggtaagactgttttatccttaatctgcattcttctttcattgtagaatacagtatttgcaactcattttttcttgtttttattacagatatacttactttctctttgatctattattgtagacactatacattcaaattgacatttaagaccaaacatctcttatgttatctttaatattactttgaataatgattgcaatgatgtttcttcctgtgattccacataacatttagaataatgatgtcaattttttacaactgaatttatttctagtgctttacttatatttggctttttgactcttttaaaacaatcagcctgcatttatataacttttataaataataatataatttgggtcaagttaagatattaaaagttcctttcagcattgaaa

SEQ ID NO: 125075 - DNA, 2278 bp, Homo sapiens
  Payload ID: 4553
  Gene Symbol: DCAF15
  Gene Name: DDB1 and CUL4 associated factor 15
  Uniprot ID: Q66K64
  ENST ID: ENST00000254337
  CDS Start-End: 22-1824
aagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttttccaaatgcggccgctacgtcctctcctacaccagcagcagtggggatgacgacttctccttctacatctaccatctgtactggtgggagttcaacgttcacagcaagctcaagctggtccggcaggttcggctattccaggacgaggagatctacagcgacctgtacctgaccgtatgcgagtggcccagcgacgcctccaaggtcatcgtcttcggcttcaacacccgctcggccaacgggatgctcatgaacatgatgatgatgagtgacgagaaccaccgtgacatctacgtcagcaccgtggccgtgccaccgccaggccgctgtgctgcttgccaggatgccagccgagcccacccaggagacccgaatgcacagtgcctacggcatggcttcatgctgcacaccaagtaccaggtggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgaccggcactagtgttagcctgcggaacggggctgggcagggcagcctctgttggcctgagggtctggacgctttttatttatgcctatttaagttgggaaggggcagagagagggcgccccctgccccaccagcctgagtgccccgccttcaccccgagctgggcatgggcctggcccctcgtgcatttgcccttttctcggctacagctgtggacgttgccctcggggaggtcgaatggaccccattccccctgccctgcccgcccccagcctccccacccaggccggcaacctggccatccccattccgttcttcttcatgtaataaatgttttaatttctgaacctca

SEQ ID NO: 125076 - DNA, 815 bp, Homo sapiens
  Payload ID: 4553
  Gene Symbol: DCAF15
  Gene Name: DDB1 and CUL4 associated factor 15
  ENST ID: ENST00000585468
  CDS Start-End: 1-815
tggtctaccccttccccaccttccagcccgccttccagctcaagaaggaccaggtggtgctgctcaacaccagctactccctggtggcctgcgccgtctccgtccactcggcaggtgacaggagtttctgccaaatcctgtatgaccacagcacctgccccctggcgcctgccagcccccctgagccccagagcccagagctgccccctgccctccccagcttctgccctgaggcggccccagcccgttcttctgggtctcctgagccctcgcccgccattgccaaagccaaggagtttgtggctgacatcttccgccgggccaaagaggccaagggcggggtccctgaggaagcccggcctgccctgtgcccaggaccctctggcagccgctgccgtgcgcactctgagcccctagccctgtgtggagagacggcaccccgggacagcccccctgcctcggaggcacctgcctccgagcctggctatgtcaactacaccaagctgtactatgtgctggagtccggagaggggacggagccggaggatgagttggaggacgacaagatctccctgcccttcgtggtgactgatcttcgtggccgcaacctgcggcccatgcgggagcggactgctgtccaggtgggtgtgggcagtgggcgggccaaggacagtcccggggagctgccggggggcagttggcaccgtcccctgcgcctacccactcacccgcagggccagtacctgacagtggagcagctcacactagacttcgaatatgttatcaatgaggtcatccgccacgacgctacctgg

SEQ ID NO: 125077 - DNA, 506 bp, Homo sapiens
  Payload ID: 4553
  Gene Symbol: DCAF15
  Gene Name: DDB1 and CUL4 associated factor 15
  ENST ID: ENST00000591802
  CDS Start-End: 1-165
gcgcccagctcgaaatcggagcggaacagcggggctgggagcggcggcggcggccccgggggagccggagggaagcgggcagcagggcggcggcgggagcacgtcctcaagcagctggagcgggtcaagagcccctgccgctggctttgggcttcctccgcctgatgttcctctccctgcccaagccccgaccacacatgagctgggagttccagtacctgggtgggcctccccattgaaagtgtgggagctccctggatagggctgagtcttcccccgcagagtgagagttaccgaagcaggctctgtctcctccatcagactggaaactcccagagctgggggatgatgtctctctcccccatcagtttgggagctctggagggcagaaatgtggatctcttgcagatcagcggacagctctcccctcgcctcttccggaagctgcctccccgggtgtgcgtgtccctcaagaacattgtggatgaggacttcctctatgcagg

SEQ ID NO: 125078 - DNA, 711 bp, Homo sapiens
  Payload ID: 4553
  Gene Symbol: DCAF15
  Gene Name: DDB1 and CUL4 associated factor 15
  ENST ID: ENST00000587307
  CDS Start-End: 1-605
ccccacttcctgcctccccagagttggaggacgacaagatctccctgcccttcgtggtgactgatcttcgtggccgcaacctgcggcccatgcgggagcggactgctgtccagggccagtacctgacagtggagcagctcacactagacttcgaatatgttatcaatgaggtcatccgccacgacgctacctggggccatcagttctgttctttcagcgactatgacatcgtcattctggaggtctgcccagaaaccaaccaggtcctcatcaacattggcctgctgctcctggccttcccgtcccccactgaggagggccagctccgaccaaagacctatcacaccagcctcaaggtggcatgggacctcaacacagggatcttcgagacagtcagtgtaggcgacctgactgaggtcaaagggcagaccagcggcagtgtctggagctcctaccgcaagagctgcgtggacatggtcatgaagtggctggtgccggagagcagcggccgctacgtcaacaggatgaccaatgaggcgctgcacaaagggtgctccctgaaggttctggcggacagcgagcgatatacgtggatcgtgctgtgagggccaggccgccccggacactgactccaactacctccgtggcctgggaccggcccccttcctggggtggcctcttcctggccggctggcccaccgactgatgacc

SEQ ID NO: 125079 - DNA, 4548 bp, Homo sapiens
  Payload ID: 4554
  Gene Symbol: DCAF16
  Gene Name: DDB1 and CUL4 associated factor 16
  Uniprot ID: Q9NXF7
  ENST ID: ENST00000382247
  CDS Start-End: 1062-1712
cggaagtagcgtcggcgcgggagctgagcggagtggccttgccaccggaggggaagggctgctggcgttaggcctggctgggtcgtgcggctgagcgtgaggctagaaagaaaaagcgatcctccaagagtgagaacgggagatctgccgaggataacaacctcccttgtggccgaagggcgggggatccccacacgagggctccgcttcgagagacggcgacaaaggaaagttcgtagcgcgttccggaggcccggccacctctgagaagggagacgacgctgctgggtccgctgagcggggcgacccgagcttatatagaattggtgataggatcacaacttctgaggtcccagcaagagtcctaacatctagcagctctaccaccaggacaggccccctaaaactaattccaacaagcacctctgaagtcttctcattcacaggttaaggctacctttccagataatccaacagctaaatcaccagtttccaagggcatttgcatcacctatggaaagcatcggatccttatacaccagatgttcttgacagctcatcccgtcattcccccctgcacaaaagttgctataccagcggacaagcaagacaactactgagcttcttttgattgtcaagtagatataatatcactgccagcaaaacagcacaaaaagtgtctcttcacagtatcactaccagttgggactatgctaagtaaatcagcttgcctagatgaggaccccttctattcttgggtagccaggatttgaaggagatactctgacctgtgccagtggtaagtgactaatacttttacacactgaactggtcctggaaactgagatgtcttctttgtaagtgaagaatatacaacataatcttgaagaacggcacagtggtatgggccacaagcatactttatgtgtgtaacggactgaaagacaaattaatcttggtgaaaggatttttcatctcttatttctatttgccagtgttagtcagtgttctgctggcttagattattacctttttctggttccttactgtgttttattctgatgggtcctagaaatccctctcctgaccacttgtcagaatcagaaagtgaggaagaagaaaatattagttacctaaatgagagttctggggaagagtgggattcctctgaagaagaggactctatggtgcccaacttatcgcctcttgagagtcttgcctggcaggttaagtgccttttaaaatattccacaacttggaaacctttaaatcctaattcctggttgtatcatgctaaactgttggatccaagcacaccagtccatatacttcgagagataggtctaagactctcccattgttcccattgtgtccccaaactggaaccaattcctgaatggccccctctggcctcttgtggagtcccaccttttcaaaagcctcttacaagtcccagccggctctctagagatcatgccactctaaatggagcactgcaatttgccaccaaacagctaagccgaacattgagtagagccactcccatacctgaatacctaaaacagatccctaattcatgtgtttctgggtgttgctgtggctggctgactaaaacagttaaggaaacaactcgtactgaacccatcaacactacttattcttacactgacttccaaaaggcagttaacaaactcctaactgcatcactgtaaagatctaccatttgctctgatatctctgatgttgctaattgagaaagtggtacaaagttagtcattacacagcccactaatgccttctcagtcaaactctcttatgccctggcaagccaatgaggataccctttgacaaaccctgtggataaaatgataatatcaaggtcaggcatggtggctcacacctgtaatcccagcactttgggaggctgaggcgggtggatctgctgaagtcagaagtttgagaccagccttgccaacacagtgaaaccctgtctctactaaaaataaaaaaattagccgggcgcagcagtgcacgcctgtaatccctgctactcgggaggctgaaacaggagaatcacttgaacccaggagacggaggttgcggtgagttgagattatgccactgtactccagcctgggtgacagagcgagactcagtctcaaaaaaaaaaaaggagaattagttaaggggaccatattacaaaagatagttgaatattcttcacactcacttctcaccctccccaccccaatttactctgcctttctgaatggctttaatgagatacctgattattaatgaagaaaagtagaccaccaccccttttgttatccagactttagaacagccattgttgaaagcaagaagttagctacccacaataatacctttctgagcatactcttctctaacatacatttctgtggaagtagttgaattaaattgagtaactacacaaaggaaaatggcagggctatgaatttctttcccagcttttatatagatgtgcctacatatgacactctttagggttccttttattttttctttttttttttttttgaggtagttgaattaaactgggtaactacacaaaggaaaatggcagggatatgaatttctttcccagcttttatatagatgtgcctgcatatgacactctttagagttcctttcactttttcttttttttggaagggggcggggaggcaggaggagtgcagttttaagcctagcctatactactacaaacttattatggtacttaaaattacagcatgaacgttctatatcggagtctcccaccaggctgtctctgactaaatcagcctataagatcatcccttgggattaaacaaacacctgttctgtagggaatgtgtttcctgaatcttggtactcagacttttgtcaagagtaaataacatttcaaaagatgaatggaaaaatgattaagagagcatttctgctttcagcattaactgctaatggattaaaattttaatctgtatagcatttcctggagtaaaagctcaagtactttccacatccattgcaaacttttcaggaacccttctaattttttttttttttttttttttgagacggagtcttgctctgtcgcccaggctggagtgtagtggcatgatctcagctcactgcaagctctgcctcccgggttcgtgccattctcctgccctgcctcccgaatagctgggactacaggcgtccaccaccactcctggctatttttttgtatttttagtagagacagggtttcaccgtgttagccaggatggtcttgatctcctgacctcgtgatccacctgcctcggcctcccaaagtgctgggattgaacccttctaattttaaagaaccttgttattagaaaatctcagcctaatacaatctgaagttaagagttttagcagcattgtttttctaagtagatttagctatagattttcttctggccaaacaaggaagagtatatgcccttgtaaatgagtcttgttttgtttatttaaatagtcagtcaaaacgtagaaatcagtatacgtaaaataaaatgcatgagactattaaatcttttcatatactctacaaataaaatgaaatctgtgtgtggtcctggttgactgggcatctaaagggaatcagaaaagagattgtgaaaagttatatatatatcctcttccttattttagttttgctttttcctattttccataattaagtgccgtttacaaagtggcatcaaaaaattgaagcaggccaggcatggtggctcatgcctgtaatcccaacagtttgggaggctgagggcaggtggatcacttgagatcaggagttcgtgaccagcctggccaacatggtgaaagcccatctctactaaaaatataaaaattagccgggcgtggtggcatgtgcctgtaatcgcagctacttgggaggctaagacaggagaattgcttgaacctgggaggtggaggttgcaatgagctgagatcgcgccactgcactccagcctgggcaacagtgagacaccgtctcaaaaaaaaaaaaggttaggaatcacaaattgtgtaaatatatagcaactttaagaagagagaagaatgcttataacctagtgaatatttctgctgagccttagttgtcttgtctaaaggaaaaaagagggaattgtagaataaaagtatttgttagtggaaattattgacctgaaaccatatcatattgttagtgtaactgaatgtatcagaaattgttcctatgtaggtattctgtgaaactggtttctaaaatgttacaggaaactgtttcctttttttttgtttgtttgtttaagtggaggtgggaggaggtagggaagaggtctgaatattaaaatatgtttatgttcatgtgttcataatacgttcctttttctctctgtgtgtgtataaaagtgccttgctcatgaatgcatttttgctattcacttcgaaaggaagcctttccccagcttggcagctgaataaaccaatagctttgtacatgctgaa

SEQ ID NO: 125080 - DNA, 868 bp, Homo sapiens
  Payload ID: 4555
  Gene Symbol: DCAF17
  Gene Name: DDB1 and CUL4 associated factor 17
  ENST ID: ENST00000339506
  CDS Start-End: 1-815
gcaggcattcaacaacatgttttgctgtaccttgcagtgttccgagttctacctttttcacttgtagggattctagagatcaacaaaaagacatgccaccactgctctttgaggtgtcatccctggagaatgcttttcagattggaggccatccttggcactacatcgtcacacctaataagaagaaacagaaaggagttttccatatttgtgccctaaaagacaattccctggcaaaaaatgggatccaagaaatggattgttgttctctagaatctgactggatctatttccatcctgatgcttctggtagaataatacatgttggtccaaatcaagtcaaagttttgaagctaactgaaatagaaaataatagttctcagcatcagatctctgaagattttgtcattttggccaacagggagaaccataaaaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagc

SEQ ID NO: 125081 - DNA, 5828 bp, Homo sapiens
  Payload ID: 4555
  Gene Symbol: DCAF17
  Gene Name: DDB1 and CUL4 associated factor 17
  Uniprot ID: Q5H9S7
  ENST ID: ENST00000375255
  CDS Start-End: 328-1890
actaggaactacatttcccggtgagagagcggctccggccggccgcgcggtaccggagcgtcgcactgtcagcggccagagagcctggggcagatcgaaaagggagtgcttcttcccttctctccgcgctctggcggtgcaagcggctctgctttccctcgccccgccgtcgggtgctccctgcccgcctccccgtgtcagctttccctgggccccgccgggaaagtctgggcctcgaaattcgaaggcagcggcggctgcccagcacgggagtgtggggcgcgccactcggcggcccagcctacccagggcccggcccgcgcctccatgggcccgacccggaagcccaacgtgtgcagccggctgagtcgccgggcgctgggctgcttctcgcgcgacgcaggcgtggtgcagaggaccaacctgggcatcctgcgggcgctggtgtgccaggaaagtactaaatttaagaatgtctggacaactcattccaggtcacctatagcctatgagagaggaagaatatattttgacaattatcggcgctgtgtcagcagtgttgcatctgagccaagaaaactttatgaaatgccaaaatgttccaaatcagaaaaaatagaggatgctttattatgggaatgcccagtgggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggcaggcattcaacaacatgttttgctgtaccttgcagtgttccgagttctacctttttcacttgtagggattctagagatcaacaaaaagatttttgggaacgttacagatgctaccttgtctcatggaatactgattgtgatgtacagctcaggactggtcagactctatagcttccaaaccatcgctgaacagttcatgcaacagaaacttgacttagggtgtgcatgcagatggggtgggactactggaactgtaggagaggctccttttggcattccttgtaatattaaaatcacagacatgccaccactgctctttgaggtgtcatccctggagaatgcttttcagattggaggccatccttggcactacatcgtcacacctaataagaagaaacagaaaggagttttccatatttgtgccctaaaagacaattccctggcaaaaaatgggatccaagaaatggattgttgttctctagaatctgactggatctatttccatcctgatgcttctggtagaataatacatgttggtccaaatcaagtcaaagttttgaagctaactgaaatagaaaataatagttctcagcatcagatctctgaagattttgtcattttggccaacagggagaaccataaaaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagctgcgtccaatccattttattatctgcatggcacattctccagtattttccaaaaaagtcttgtgttgacttcagatgactatgacttcttttttaaactcttgctgtaaaagatggtgaggacttcattttttttaaaggttttttagaatactgttccaagaagtttagtgttttgcagctttgagctaggtggtaatgcaaatataaaatgctgggaacagaaaaggacaggttaattccaattgttgaggagttaagtcattgatggggtgggtcattgatgagttcttaaaggatggtatggaattttgtttgttaaggctaggaaagacagggagagacaaaagtaaacatgcagaaagaaatcttatatcctctataccaaactttgcttaaggatgagaaatgagatgtgttatgtgagaacattattttgagcccaaaatgtgtcatcacagtttttaaaaatcttatatatgtatttatatgtgtttcgtatttgtatatagtatcaggaattggttctagttcccaaattatcttttcttccttggttttgttctcttggcttgatgttcacattgaatatttgtgtttctatataggctaatgtaaaagattccaagcaaaccttaagtgaaattgttttctgatttgcatcctgtttagctcttaatgtatctaaggatgttctcatctcaccattctactcatttagtgagttttctgatcttgtttaggcaatatttgcatacttatgcaataagataaaggtacccttgcctgcagtagttctgtttcctgtagaaaagtggataaagagtcccagaagaagttcttactagcttgggagttacctgattaaccagagaaaatttttggcttacttatggaacaagcattatttcttctttgttaggaaagatctaaatatggtccttgacttttaataatcattctttagaatgttaaataaaggcaacccaagtaaagggagaaaatgtttctttgtgcttcctgtttgagaaattcagttgcttccatttcgcatgttctgcacatttatccgatgtaacctcaaaagaataactggtaataagggaaggaaacagcagcaacaatcattgctgattcaagtttaaggttaaaatatggaatttttagcttggatgatttatattaaaatctttccattttttttttcagttttggcttgatgccatgttaagaatgatgtgaattcttcccagttctgccctggtgctagacattgccccatactttcaattagacactagctgtatctaaatagtcccactcagtaaacttacatcttgaaaaacaagaccagtaagaggccagtgaaagtactaaagaaagaaaccaatgttgtgtgagtttcaaagcagctgcaatgctgtgtaaaagtagagtgttcattctccatttccaagagtgtttcagaataggatgtcttaagacttcagtcatgtcagagatttttttttttaggtgattattgagtttctccttctcctttaagtcatcaccttccttttatgaaatgatagtaaggaactcgtctattctgaaaggcatttgagaaatagctgaattcctggctgcttttttgctgggggtagatggtggaatacttctggtctagatataacttaccactaagaaacccccagtatgtcaccactgcctaaatctaactagaccagggtccaaatgccatccaggccaggcaggaaatatacctcatgtgaaagacagtaaggagttgtgggcagtgtaacaaacaggagagctatgccccaactaaaaggagcagctgctactgcttagtttcagccagttgcaacagtatgtgggaatgtaggctgcatggttgttaacaagatagatggtaaaaagatgccagaagatacagaagatagcaaagaatgtggggaatttggataccacacatagcgagagacaatgaagcatgcttcccagctcgccagagtgtcacacagctgctcattctgccacctgccagacattaatgtcttcctgccctacctaaaccccctctttacctgatattttaattcgagactctagctacatgcccacctacttaacaggtactagtgacaggtacaaaacattatgggtaacaattctgagtgtttaatgcaagcccaggtgaagcagggtagcttccatcagcaggtacagacgttacgctgaaaagaggtgcattctgcattgcactcctggatctaagtttctgcattctcagagcatcaatgcagcaagcttattgttcctcaattttttacaatatttatcacaactctgggagaaaacaaaacaaatcctatcctatttactatttgtgctacctagtgaggagataccgctctgtttagacaaattaaggcacttcacattcttccaccaattgaaagttttgtatcttacagttctttttttaaataatatatttattgagcactttctatctactagtcactgtgatacagtataagtaaagtgggttgtctcatttaatattcagaataaccacatgaagtatgaactgccattatctttcccctttgtacaaatgaggaaagtgaggctcacagaagttaattggcccagggtcccacaactagtcagtgcagaggtgggaaacataaccagatttgttcggcatgaacttgtgccaaatttcctccaaagttctcaaaaggcaaggcatgttattttatcccaatttagcataccaacaactataatactagatatgtaggaaagtgcttaataatcgttttttactgatgattcagtgtctaaattttgaacaaatttgggtaagatacaagtcacacataaattgacagaaaatgtagttcttcattcaatggttagcagtcattaaaaggtactttccctttgtttgtggtgataatcagtattagtagttttcatattatttggcttccatattaatcatttttatattttcttctccttcttaccatgtttacttatatcatccatcttttagaatcccagggagctaatttctggtccctgtgttgctatcaaatctgtatcttgcagaaagaataatttatttcaaacaagggacatacaatagaaagataagacctactgaggtctttttcccatcattttattatgaaaaatgttcaaacatacagtaaaattgaaagaattttatagtaaatactgaccacggggattctacatcttactctacttgttttattattttcctatccagcgtactttttgatggatttcaaaataaattgcagttgctgatatacttccccctagtacttcaactgcagattattaactagagtttagtatttatttagtttttaaatttttttgatttaagatttacctgcaataaaatgtacaaatcttaagtataaatttactgagttcttgcagacatatacacctgtgtaacccaaaccctttccaaaatttagaccattgcaatcatcttcagaaagtttcctaaatccctctcccagtctatcccctccccacccctcaggtataactactgttctcattcttttatatcaaaggttaaatttacctgttctaaacttcatatgagtgaaattatacaaaatgtaatgcttctttcacttagcataatgtttttgagatttattcatgttgttgcatgtgtcagtgattcatttctttttattgctgagtattctttcgtatgaatatatcacagtttgtttttttatctttctgttgatggacactgggctctttctgcttgttttttactgttatgaataaagctgctatgaacattcttagacaa

SEQ ID NO: 125082 - DNA, 758 bp, Homo sapiens
  Payload ID: 4555
  Gene Symbol: DCAF17
  Gene Name: DDB1 and CUL4 associated factor 17
  ENST ID: ENST00000436317
  CDS Start-End: 1-385
gaggaccaacctgggcatcctgcgggcgctggtgtgccaggaaagtactaaatttaagaatgtctggacaactcattccaggtcacctatagcctatgagagaggaagaatatattttgacaattatcggcgctgtgtcagcagtgttgcatctgagccaagaaaactttatgaaatgccaaaatgttccaaatcagaaaaaatagaggatgctttattatgggaatgcccagtgatggagtcttctgtcgccaggctggagtgcagtggcacgatctcagctcaccgcaacctccacctcccgggttcaagtgattctcctgcctcagcctcccaagtagctgggattatagggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggcaggcattcaacaacatgttttgctgtaccttgcagtgttccgagttctacctttttcacttgtagggattctagagatcaacaaaaagatttttgggaacgttacagatgctaccttgtctcatggaatactgattgtgatgtacagctcaggactggtcagactctatagcttccaaaccatcgct

SEQ ID NO: 125083 - DNA, 833 bp, Homo sapiens
  Payload ID: 4555
  Gene Symbol: DCAF17
  Gene Name: DDB1 and CUL4 associated factor 17
  ENST ID: ENST00000431110
  CDS Start-End: 1-668
gagaaattaaattaaatgacttctgtaaagccagtgaagttaatatatccaagttgatgttcgttcccagtgcttctggatataaggcaaaaaatgggatccaagaaatggattgttgttctctagaatctgactggatctatttccatcctgatgcttctggtagaataatacatgttggtccaaatcaagtcaaagttttgaagctaactgaaatagaaaataatagttctcagcatcagatctctgaagattttgtcattttggccaacagggagaaccataaaaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagctgcgtccaatccattttattatctgcatggcacattctccagtattttccaaaaaagtcttgtgttgacttcagatgactatgacttcttttttaaactcttgctgtaaaag

SEQ ID NO: 125084 - DNA, 5623 bp, Homo sapiens
  Payload ID: 4555
  Gene Symbol: DCAF17
  Gene Name: DDB1 and CUL4 associated factor 17
  ENST ID: ENST00000539783
  CDS Start-End: 328-1689
actaggaactacatttcccggtgagagagcggctccggccggccgcgcggtaccggagcgtcgcactgtcagcggccagagagcctggggcagatcgaaaagggagtgcttcttcccttctctccgcgctctggcggtgcaagcggctctgctttccctcgccccgccgtcgggtgctccctgcccgcctccccgtgtcagctttccctgggccccgccgggaaagtctgggcctcgaaattcgaaggcagcggcggctgcccagcacgggagtgtggggcgcgccactcggcggcccagcctacccagggcccggcccgcgcctccatgggcccgacccggaagcccaacgtgtgcagccggctgagtcgccgggcgctgggctgcttctcgcgcgacgcaggcgtggtgcagaggaccaacctgggcatcctgcgggcgctggtgtgccaggaaagtactaaatttaagaatgtctggacaactcattccaggtcacctatagcctatgagagaggaagaatatattttgacaattatcggcgctgtgtcagcagtgttgcatctgagccaagaaaactttatgaaatgccaaaatgttccaaatcagaaaaaatagaggatgctttattatgggaatgcccagtgggagatatacttcccaattcatcagattataagtcctcactcatagcactgactgctcataattggctacttcgtatatcagcaactacgggaaaaatccttgagaaaatatatcttgcaccttattgcaaattcagatacttgagctgggacactcctcaagaagtcattgcagttaagtcagctcagaacagaggctcagcagtggcccggcaggcaggcattcaacaacatgttttgctgtaccttgcagtgttccgagttctacctttttcacttgtagggattctagagatcaacaaaaagatttttgggaacgttacagatgctaccttgtctcatggaatactgattgtgatgtacagctcaggactggtcagactctatagcttccaaaccatcgctgaacagttcatgcaacagaaacttgacttagggtgtgcatgcagatggggtgggactactggaactgtaggagaggctccttttggcattccttgtaatattaaaatcacagacatgccaccactgctctttgaggtgtcatccctggagaatgcttttcagattggaggccatccttggcactacatcgtcacacctaataagaagaaacagaaaggagttttccatatttgtgccctaaaagacaattccctgaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagctgcgtccaatccattttattatctgcatggcacattctccagtattttccaaaaaagtcttgtgttgacttcagatgactatgacttcttttttaaactcttgctgtaaaagatggtgaggacttcattttttttaaaggttttttagaatactgttccaagaagtttagtgttttgcagctttgagctaggtggtaatgcaaatataaaatgctgggaacagaaaaggacaggttaattccaattgttgaggagttaagtcattgatggggtgggtcattgatgagttcttaaaggatggtatggaattttgtttgttaaggctaggaaagacagggagagacaaaagtaaacatgcagaaagaaatcttatatcctctataccaaactttgcttaaggatgagaaatgagatgtgttatgtgagaacattattttgagcccaaaatgtgtcatcacagtttttaaaaatcttatatatgtatttatatgtgtttcgtatttgtatatagtatcaggaattggttctagttcccaaattatcttttcttccttggttttgttctcttggcttgatgttcacattgaatatttgtgtttctatataggctaatgtaaaagattccaagcaaaccttaagtgaaattgttttctgatttgcatcctgtttagctcttaatgtatctaaggatgttctcatctcaccattctactcatttagtgagttttctgatcttgtttaggcaatatttgcatacttatgcaataagataaaggtacccttgcctgcagtagttctgtttcctgtagaaaagtggataaagagtcccagaagaagttcttactagcttgggagttacctgattaaccagagaaaatttttggcttacttatggaacaagcattatttcttctttgttaggaaagatctaaatatggtccttgacttttaataatcattctttagaatgttaaataaaggcaacccaagtaaagggagaaaatgtttctttgtgcttcctgtttgagaaattcagttgcttccatttcgcatgttctgcacatttatccgatgtaacctcaaaagaataactggtaataagggaaggaaacagcagcaacaatcattgctgattcaagtttaaggttaaaatatggaatttttagcttggatgatttatattaaaatctttccattttttttttcagttttggcttgatgccatgttaagaatgatgtgaattcttcccagttctgccctggtgctagacattgccccatactttcaattagacactagctgtatctaaatagtcccactcagtaaacttacatcttgaaaaacaagaccagtaagaggccagtgaaagtactaaagaaagaaaccaatgttgtgtgagtttcaaagcagctgcaatgctgtgtaaaagtagagtgttcattctccatttccaagagtgtttcagaataggatgtcttaagacttcagtcatgtcagagatttttttttttaggtgattattgagtttctccttctcctttaagtcatcaccttccttttatgaaatgatagtaaggaactcgtctattctgaaaggcatttgagaaatagctgaattcctggctgcttttttgctgggggtagatggtggaatacttctggtctagatataacttaccactaagaaacccccagtatgtcaccactgcctaaatctaactagaccagggtccaaatgccatccaggccaggcaggaaatatacctcatgtgaaagacagtaaggagttgtgggcagtgtaacaaacaggagagctatgccccaactaaaaggagcagctgctactgcttagtttcagccagttgcaacagtatgtgggaatgtaggctgcatggttgttaacaagatagatggtaaaaagatgccagaagatacagaagatagcaaagaatgtggggaatttggataccacacatagcgagagacaatgaagcatgcttcccagctcgccagagtgtcacacagctgctcattctgccacctgccagacattaatgtcttcctgccctacctaaaccccctctttacctgatattttaattcgagactctagctacatgcccacctacttaacaggtactagtgacaggtacaaaacattatgggtaacaattctgagtgtttaatgcaagcccaggtgaagcagggtagcttccatcagcaggtacagacgttacgctgaaaagaggtgcattctgcattgcactcctggatctaagtttctgcattctcagagcatcaatgcagcaagcttattgttcctcaattttttacaatatttatcacaactctgggagaaaacaaaacaaatcctatcctatttactatttgtgctacctagtgaggagataccgctctgtttagacaaattaaggcacttcacattcttccaccaattgaaagttttgtatcttacagttctttttttaaataatatatttattgagcactttctatctactagtcactgtgatacagtataagtaaagtgggttgtctcatttaatattcagaataaccacatgaagtatgaactgccattatctttcccctttgtacaaatgaggaaagtgaggctcacagaagttaattggcccagggtcccacaactagtcagtgcagaggtgggaaacataaccagatttgttcggcatgaacttgtgccaaatttcctccaaagttctcaaaaggcaaggcatgttattttatcccaatttagcataccaacaactataatactagatatgtaggaaagtgcttaataatcgttttttactgatgattcagtgtctaaattttgaacaaatttgggtaagatacaagtcacacataaattgacagaaaatgtagttcttcattcaatggttagcagtcattaaaaggtactttccctttgtttgtggtgataatcagtattagtagttttcatattatttggcttccatattaatcatttttatattttcttctccttcttaccatgtttacttatatcatccatcttttagaatcccagggagctaatttctggtccctgtgttgctatcaaatctgtatcttgcagaaagaataatttatttcaaacaagggacatacaatagaaagataagacctactgaggtctttttcccatcattttattatgaaaaatgttcaaacatacagtaaaattgaaagaattttatagtaaatactgaccacggggattctacatcttactctacttgttttattattttcctatccagcgtactttttgatggatttcaaaataaattgcagttgctgatatacttccccctagtacttcaactgcagattattaactagagtttagtatttatttagtttttaaatttttttgatttaagatttacctgcaataaaatgtacaaatcttaagtataaatttactgagttcttgcagacatatacacctgtgtaacccaaaccctttccaaaatttagaccattgcaatcatcttcagaaagtttcctaaatccctctcccagtctatcccctccccacccctcaggtataactactgttctcattcttttatatcaaaggttaaatttacctgttctaaacttcatatgagtgaaattatacaaaatgtaatgcttctttcacttagcataatgtttttgagatttattcatgttgttgcatgtgtcagtgattcatttctttttattgctgagtattctttcgtatgaatatatcacagtttgtttttttatctttctgttgatggacactgggctctttctgcttgttttttactgttatgaataaagctgctatgaacattcttag

SEQ ID NO: 125085 - DNA, 975 bp, Homo sapiens
  Payload ID: 4555
  Gene Symbol: DCAF17
  Gene Name: DDB1 and CUL4 associated factor 17
  Uniprot ID: Q5H9S7
  ENST ID: ENST00000611110
  CDS Start-End: 200-922
aggcaggcattcaacaacatgttttgctgtaccttgcagtgttccgagttctacctttttcacttgtagggattctagagatcaacaaaaagatttttgggaacgttacagatgctaccttgtctcatggaatactgattgtgatgtacagctcaggactggtcagactctatagcttccaaaccatcgctgaacagacatgccaccactgctctttgaggtgtcatccctggagaatgcttttcagattggaggccatccttggcactacatcgtcacacctaataagaagaaacagaaaggagttttccatatttgtgccctaaaagacaattccctggcaaaaaatgggatccaagaaatggattgttgttctctagaatctgactggatctatttccatcctgatgcttctggtagaataatacatgttggtccaaatcaagtcaaagttttgaagctaactgaaatagaaaataatagttctcagcatcagatctctgaagattttgtcattttggccaacagggagaaccataaaaatgaaaatgtactcactgttacagcttctggacgggtggtaaaaaaaagttttaaccttctggatgatgacccagaacaagagactttcaaaattgtggactatgaagatgagttagatttgctttctgtggtagctgttactcaaatagatgctgaaggaaaagctcacctggatttccactgtaatgaatatggaactttacttaaaagcattccactagtggagtcatgggatgtgacatatagccatgaagtctactttgacagagacttggtgctacacatagagcagaaacccaacagagtcttcagctgctatgtttaccagatgatatgtgacactggggaagaagaagaaaccataaacagaagctgttaaaaagagtgagataattgtaacctaagagacttttagccaaacaccccagcagc

SEQ ID NO: 125086 - DNA, 1940 bp, Homo sapiens
  Payload ID: 4556
  Gene Symbol: DCAF4
  Gene Name: DDB1 and CUL4 associated factor 4
  ENST ID: ENST00000353777
  CDS Start-End: 176-1153
tgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaaggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtt

SEQ ID NO: 125087 - DNA, 2024 bp, Homo sapiens
  Payload ID: 4556
  Gene Symbol: DCAF4
  Gene Name: DDB1 and CUL4 associated factor 4
  Uniprot ID: Q8WV16
  ENST ID: ENST00000358377
  CDS Start-End: 221-1708
atgagatcgtccctattgacgtcgacagacagaagccgcgtccagtgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagatt

SEQ ID NO: 125088 - DNA, 2360 bp, Homo sapiens
  Payload ID: 4556
  Gene Symbol: DCAF4
  Gene Name: DDB1 and CUL4 associated factor 4
  Uniprot ID: Q8WV16
  ENST ID: ENST00000394234
  CDS Start-End: 275-1462
gcacgcttcgctccaactcctgcagagctgagccggaggggaatccggaagggacacgctgaacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaagaatcatggtgtgacatgcacttctgtgaatgacttaggagatcatgagcttgggctgct

SEQ ID NO: 125089 - DNA, 1872 bp, Homo sapiens
  Payload ID: 4556
  Gene Symbol: DCAF4
  Gene Name: DDB1 and CUL4 associated factor 4
  ENST ID: ENST00000509320
  CDS Start-End: 102-326
gctacaccttggtctttccgggtccttgcacgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactgataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagatt

SEQ ID NO: 125090 - DNA, 1521 bp, Homo sapiens
  Payload ID: 4556
  Gene Symbol: DCAF4
  Gene Name: DDB1 and CUL4 associated factor 4
  Uniprot ID: Q8WV16
  ENST ID: ENST00000509153
  CDS Start-End: 73-1380
acgcttcgctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaaggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctg

SEQ ID NO: 125091 - DNA, 2896 bp, Homo sapiens
  Payload ID: 4556
  Gene Symbol: DCAF4
  Gene Name: DDB1 and CUL4 associated factor 4
  ENST ID: ENST00000553457
  CDS Start-End: 291-1292
gtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggcccagcagtttgctctcatggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcaggtacttgaggaaggaaggggaagttccaccccatcaaatactgtctctcaggggcgatcccagcaacttcagcagcagagggaaaagttaccccaaaacagaactgaatcaaggggagtgtggacagctgggtggggagactaggagggaagtagaattagattatattagtaatcaggagtgtaaataaatgtccaccaggtggacagcctcatcccatgtcagtgggcaaacgtcacttcagaaacaggcaggtggggaggtcctggggagcctgggtttggagtttgagtggatttcatcaggccagcattattccaccacgcaactatcttatccaaaaacttgggctccctgttgtctctactcacatttccaccagaggatgctgagaaaagaagttatggtcattgtaaagattcttggccccggcccggcgcggtggctcacgcccgtaatcccaacactttgggaggccaaggagggtggatcacgaggtcaggagattgagaccatcctggccaacatggtgaaaccccatctctactaaaatacaaaaattaactgggcatggtggcacctgcctgtaatctctcagctactcggaagtcagaagcaggagaattgcttggaccaggaagtcggaggttgcagtgagccgatatcacgccactgcactccagcctggcaacagagcgagactccgtctcaaaataaataaataaataaaaaagatttgtggcccctttactaccatccctgtggctccatgatctgcagattaggagcagctatctggccactaagccccctggaagggagttaccagttgattacagatgatggtggctatagcgtaatcagacagtgtgcaggctcaatgctttcacactgaaatagtagctgctgacactgcagaatgtgttctcagtcttcaagaattgtcacctctactggtattcctatagaaagggcttataccccatggaacatttttgtggctaggaagcattactttgttaggacattcatagacttatttactattctcatcaacaccaggacttcgcctcctttttaagtcgatttttcacctgtttttatcacagaagagctcttgtgagctggatgatagagagagctcagccttgctgagaggcagatgcaggtagttaccagctgcagtaataaactgcagccgggattcagcttcagccaagatagcacttctggtcttagagccacacaagtgatcagaatcacaaatgtgaaatccatgactgcccaaggcctgtcctcttctcctgctgaaggtctccagtagtgtatatcatgtttctgggctgctgtaacccatgctgttgtgtgtcacagtcctcagaactggagccctgaagacttaaaccggtcctaggaactgaagcattaaaccagaaagagctgtggggagagttgtcaacctagcccatccccaggatgtaatgactttgacagatcttttactataacatgaaaagatcaggccaggtgtggtagctataattccagcacttagggagcttgaggccaggagtttaagaccagctggggcaacacagcaagaccctatctc

SEQ ID NO: 125092 - DNA, 2374 bp, Homo sapiens
  Payload ID: 4556
  Gene Symbol: DCAF4
  Gene Name: DDB1 and CUL4 associated factor 4
  Uniprot ID: Q8WV16
  ENST ID: ENST00000555042
  CDS Start-End: 66-1535
gctccaactcctgcagagctgagccggaggggaatccggaagggacacgctgaacaggaacagaaatgaataaaagtcgctggcagagtagaagacgacatgggagaagaagccaccagcagaacccttggttcagactccgtgattctgaagacaggtctgactcccgggcagcacagcccgctcacgattccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagatggagagcaagagactgcggctgctccaggaagaagacagacggaaaaagattgccaggatgggatttaatgcatcttccatgctacgaaaaagccagctgggttttctcaacgtcaccaattactgccatttagcccacgagctgcgtctcagctgcatggagaggaaaaaggtccagattcgaagcatggatccctccgccttggcaagcgaccgatttaacctcatactggcagataccaacagtgaccggctcttcacagtgaacgatgttaaagttggaggctccaagtatggtatcatcaacctgcaaagtctgaagacccctacgctcaaggtgttcatgcacgaaaacctctacttcaccaaccggaaggtgaattcggtgtgctgggcctcgctgaatcacttggattcccacattctgctatgcctcatgggactcgcagagactccaggctgtgccaccctgctcccagcatcactgttcgtcaatagtcacccagcaggaatagaccggcctggcatgctctgcagtttccggatccctggtgcctggtcctgtgcctggtccctgaatatccaagcaaataactgcttcagtacaggcttgtctcggcgggtcctgttgaccaacgtggtgacgggacaccggcagtcctttgggaccaacagtgatgtcttggctcctctgctgtttaatggctgccgctctggggaaatctttgccattgatctgcgttgtggaaatcaaggcaagggatggaaggccacccgcctgtttcatgattcagcagtgacctctgtgcggatcctccaagatgagcaatacctgatggcttcagacatggctggaaagatcaagctgtgggacctgaggaccacgaagtgcgtaaggcagtacgaaggccacgtgaatgagtacgcctacctgcccctgcatgtgcacgaggaagaaggaatcctggtggcagtgggccaggactgctacacgagaatctggagcctccacgatgcccgcctactgagaaccataccctccccgtaccctgcctccaaggccgacattcccagtgtggccttctcgtcgcggctggggggctcccggggcgcgccggggctgctcatggctgtcgggcaggacctttactgttactcctacagctaattctgcagggcacagcccagagccatgtggatttgacttacgggagtaaagcgtaactttttactgcatctaatgagggtgttttaagtgacactcagtgtacacagatcccatcctctggctgctaggagagaagtgctgaatgttccgtgtggagatgctcaggaaagttatttgagttaaattgctggctgagagagcttggaagtccttttcataaaaggtacctctttccttttcttattgaattcttagaacttagttaaccctccctgccttttcttaacaaaaaggacttttctaaggactgaagattggcaaaaacgaaaagcttcttcctccaagagcccattgaagaagcccagtgatgagacggtgagatggtttgagtcctcggtgcctgggtagcaggaagaaagacctgcatcctgcatctgtacttggggaagccagcggagaggacggggaggttacttctctaagtttctgcagaaatattgaaggctggagtttggaatccttaaacttggccttctcaaactcagcagcagatctccgggattctgctgttattatccaaaggcgttggaaggaaagatggatcttcttacatgctagaagttttaaacggtccttaacatgcctttgttcaagcaccttccagaatgtaaggttcagcagctctggtttctattacggtgacttgaatgtcagattcaagggcccggcgtcaaaggaaattggttttgactttttgtaatctaggagcgacagttcgtgagatgtttattcagtgttaaagagcctgtttttctaccaaacaataaaaccaagagaag

SEQ ID NO: 125093 - DNA, 4772 bp, Homo sapiens
  Payload ID: 4557
  Gene Symbol: DCAF4L1
  Gene Name: DDB1 and CUL4 associated factor 4-like 1
  Uniprot ID: Q3SXM0
  ENST ID: ENST00000333141
  CDS Start-End: 98-1288
acccggacggaacttcctgtcacggaaaagaacatcctgtcacggagaagaacatcctgcagaatttcctgtcacgaggaacattccgcaggaggaaatggaggctgaaaggctgcgactcctcgaggaagaggccaagctgaaaaaggtagccagaatgggatttaatgcatcttccatgctccgaaaaagccagctaggtttcctcaacgtcaccagttactcccgtttagccaacgagctgcgtgtgagctgcatggagcggaaaaaggtccaaattcggagcttggatccctcctctttggcgagcgaccgatttaacttcattctggcgagtaccaacagcgaccagctcttcgtagtgaaccaggtcgaagtcgaaggctccaagtacggcatcatcagcctgcgaactctgaagatcccttcgttccacgtgtacgtgctcagaaacctctacgtccccaaccggaaggtgaagtccctgtgctgggcctcgctgaaccagttggactctcacgttctgctgtgcttcgagggaatcacagatgctccaagctgtgcagtgctgctcccagcgtcgcggttcttaagtgttcacacaagagttaaccagcctggcatgctctgcagtttccagatcccagaggcctggtcctgtgcgtggtccctcaacacccgggcatatcactgctttagtgcaggcttgtctcagcaggtcctgttgaccagcgtggcgacgggacaccagcagtcatttgataccagcagtgatgtcttggcccagcagtttgctagtacggctcctttgctgtttaatggctgtcgctccggggagatctttgccattgatctgcgttgtagaaatcgaggcaaggggtggagggccactcgcctgttccatgactcagcagtgacctctgtgcaaatcctccaagaagagcaatgcctgatggcatcagacatgactggaaagatcaagctgtgggatctgagggccactaaatgtgtaaggcagtacgaaggtcacgtgaatgagtccgcctatctgcccctgcatgtgcacgaggaagagggaatcgtggtggcagtgggccaggactgctacacgagaatctggagcctccatgatgcccacctgctcagaaccatcccttccccgtactctgcctccgaggacgacattcccagcgtggccttcgcttctcggctcgggggcatccggggagcagcaccagggctgctcatggctgtccggcaggacctttattgtttccccttcagctaattctgcaggtggcagcgcggccgaatgtggatttgacttaaggaagttaagagtatcttattaccgtttctgtgagagcattttaagagacgtgttgtatatagatcgcatccatccggctgccaggggtaaggtgttaagagttttatgtggagacgttcttgtaaagttatttcagttaaactgtggacttaacttgaaagtccttttcataaaaggtacctgtttcctcttgttgaatgccttagaacagttaaccacctccccaaccctttttttttttaaataattaagacttttctaaggactgaagattggcaaaaactaaaataaattaaagcagcttctttcactagtagccctttagagaagcataatgatggtactggtaagactgtttgactaatcatacagggtcccaggcatctgcgcttgaggaagccagtgggagtggagacaagggagaggtaatttctcagagtctctacagaaatatttaaggctggagtttggaatcattaaatttggccttctcaaactcaatagcagatctcttaaggttctccttttattgttatcatccataggcattggaaggaaagatggatctttttaaatactagaagttttaaacagtccttgatgtgcttttgttgaggtacctttcagaatgtaaggtacagcagctccggtttctattatggtgacttgaagttcagattcaaggaattggctttgactttttgtaatctaggagcagcagtttgtgagagatttattaaaaatgttaaagagcctgtttttctactaagcaaggaagaaaaaaaacgtgtaataaggttagttgctacttcttaatagccaaagcctggaaatgatctgaatttcgaaaatgctaaaattcgtgatataatcatacaatcggatactgcataataatagaaaataaggcacacttgctatgtgaaacagtatggaccaatctcaacatgttgactgaaattaggtagaaatgagtacaaactgtatgattcaattctaaagttcaaaagcagtaaaaacttgtctatggtgattaaaggtagagtagtacgtacctctgtagaaagaaaggatttttttttctttttctttttaggatgtttgagaagtgacatggggaagctttaggaatgctgagttttctttatcttgacacttgatacatacgtaattcatatatctatatgcttcacgtttttatagtttactgtatatatgttattcctcaaaaaataaaaataagcaattaggacactattgtagttaggcaagggacaatgatgccttggacctgcatgtgtgagaagtagaaatgatcagaaatgattgcattggaagatcattcgaaggtagtattattgataaggcttgctgatgagagtaaactagaaagtgaaagaaaaaaggatggcagcttttttttttttttttttgagacggagtctccttctgtcgcccaggctggagtgcagtggcgcgatctcggctcactgcaagctctgaggatggcagcttttttgttaactttagaactggtagatgatggtgtcgtttactaacctggggaggatgaggagaaaaaactttaggtgaagggaatgatgctgagttttagacatctactaaacctccaattggagatacaaagtattctgcagatcaggggtcatgtcatggctggtaatacaaatttggtgacttcaatacatagaattaaaatagatgggatagatgtgctttatatgacatagatgaggttaatgtaattacatattgatagaagatgagtagatcaatagagaagatatgggagtatggttaggcacagatttttggaatcctttcagtcagttttttatactaacttgatatgtgacatgagaaattgtgtaagctttacttgctgttgtttcttcagtgtaaaatgtcttagataataaaactaaatgataaagtagatacagggttaaaggatatgtatcttgtcccttttacattgtaagcattcaaaataaaacaaaacaattaatgaagaaaagacattgcaatcattcagtaagaactagctgcagacatatatatgtatatatatatatgtctgatactgatatgtcatttatttggcaattgacaaaaaatgactacataacttgataaactgtttatcctcatttgcaaagaaaacaaatgcaaaaaaaaaatcagtaagaaaaacacacctaaaagaaagggaggcaatagtcttgaataggagaaaaagaggagatccaaatggctaatatacatttgaaaaggcatccaacttcttttattgtcaaggaaatgcaaattaaaaccacaatgccacaccactttcactataatggttaaaataaaatagatcaggtggagtgacgttgggaattaaaagagaagcaaatgttggtgcagttgtgagcaaatagaactttcatatactgttgagtgtatactggtacaagcacttggaaaagttagtaattgctaaagctagaagtttgcatactctatgacccagtcatttcagtcctaggaatatattaatcagaaatgcatacctgtgtccaccataatttgttaatagctccaactggaaactacccaaatgttcattaatagtagagtggataaattgtgggatattaacacaatggaatcctttttgcagtgagaatgagcatagcactatggacaaatcctgcaaacataatgttgaaataaagatgccaaacacaaaagagcacatattgtacaactaatgcacataaagtccctaaacaggcaaaatgaatctatgttcttagaagcaggattaatggtatacttgtagggcagaagagtagtgaccagaagaagattctaggaagctagcaatgctggtgtcatgccagacccctagtgactccaatagtaatggcactgtgtccgagagtccaaagaagatgcgtagacagcgaacaagacttgggtttattgggggaacttatatatagggatggtccagtggtagtaggctggacagaagaaccactactgtttgtaaaaagcatgcagtttatatagcattttcatttagcacactccacctagcaacctccatttaacccaaagcaaaggaccttgatcccctatattgcctgtgttgtaagggatgggctgggggttcagacgtccttcatagataaggagtgaaactcagggttagtcgctcctgtttccttagtttgggattctgagcacacattcgttttagatcacagggtcgttctcaggatatggttgttactgctgtcaggtgcatcctctctatagcggggtactggctacacagtttttgttcactagtgataattgttagagctatgcccttaatatatgtcttgtgtgtattatacttcaataaaaagttaaattttaaaaaacc

SEQ ID NO: 125094 - DNA, 3326 bp, Homo sapiens
  Payload ID: 4558
  Gene Symbol: DCAF4L2
  Gene Name: DDB1 and CUL4 associated factor 4-like 2
  Uniprot ID: Q8NA75
  ENST ID: ENST00000319675
  CDS Start-End: 98-1285
gttcttccgtgccaagtcgtgcttgtaaagaagcggtacttcctcttactcccgggacagaacttcccctcaggagggagaacatccgccgaacgaaatggagagcaaaagaccgcgactgctcgaggaagcagacaagcagaaaaagacagtcagagtgggactcaatgcaccttccatgctacgaaagaaccagctaggtttcctcagattcgccaactattgccgtatagctcgcgagctgcgtgtaagctgcatgcagaggaaaaaggtccagattcatagctgggatccctcctctttggcaagcgaccgatttaaccgcatactggcgaataccaacactgaccagctcttcacagtgaaccaagtcgaagctggaggctccaagtacggcatcatcaccatgcgaggcctgacgacccctgagctccgggtatacccgcacaaaaccctctacgtccctaatcggaaggtgaattctatgtgctgggcctcactgaatcacttggattcccaccttctgctgtgcttcgtgggacttgcagatactccaagctgtgccgtgctgctcccagcgtcgctgttcataggtagcttcccaggaatgcgtcggcctggcatgctttgcagtttccagatccctgatgcctggtcctgtgcctggtccctgagcatccacgcgtatcactctttcagtacaggcttgtctcagcaggtcctgttgaccaacgtggtgacgggacaccagcagtcatttgggactagcagtgatgtcttggcccagcagtttgcaatcatgactcctttgctgtttaatggctgtcgctctggggagatctttggcattgatctgcgctgtggaaatcaaggcagcgggtggaaggccatttgcctgtcccatgattcagcagtgacttctctgcaaatcctccaagatggccaattcctggtgtcatcagacatgactggaactatcaagctgtgggacttgagggccactaaatgtgtaacacagtacgaaggtcatgtgaataactccgcctacctacccgtgcatgtgaacgaagaagaaggagtcgtggcggccgtgggccaggactgctacacgagaatctggagcctccgtcatggccacctgctcacaaccataccctccccataccccgcctcggagaacgacattcccagtgtggccttctcttctcgcctcgggggcttccgaggagcaccagggctgctcatggctgtccgggaggacctttattgtttctcctacggttaattcttcaggatgcagcccggaggaacgtggatttgacttaaagaagtaaagagcatcgtattaccgtttctatgagcgcattttaagagatgttcggtgtttgtagatcccatccatccggctgctaggggtaaggtgctgttttatgtgaagatagttctgtaaagttgtttcagttaaactgggctgagagagcttgaaagtccttttcataaaagataactatttccttttcttgttgaataccttagaatagttatccccccctttttttttttttttaacaaaaaaacacttttctaaggactgaagattggcaaaaactaaaataaattaaaactgcttacaccagaagccttttagagaagcatgagactgtttgactagtcctacctgggttccggaaatacatgcatcatctgtacttgaagaggccagtgggagaggagaggagggggaggtcatttatctgagtctctccagaagtttttaaggctacattttggaatcattaaacttggccttctcaaactcaatagcagatctctgagattctccttttattattttccataggcaatgggaggaaaggtggatctttttaaataatagaagttttaaacagtccttaacgtgcttttgttgaggcatcttccagaatgtaaggtacagcagctccggtttctattattgtgacttgaatgtcaggattcaagggctcagtgtcaaagataattggctttgactttttgtaatctaggagcagcagtttgtgagatgtttattcaaagtgttagcctgtttttctaccaacaataagctagaaaagacaaaaaaaacaaaaaacaaaaaaacgtgtaataaagttagtggctacttcttaatagccaaagcctggaaatgatctcactttacaatatgctaaaattgataaataatttgtgctgtagtcatacaattggataaagcataatataaaataaggcacaattgctatatgaaactgtggattaatctcaacatgttgattgtaaatgtaggtagaaatgagtacaaactgattcagttctaaagttccaaagcactaaaaacttatctatggtgattacagtttgaatagtaggtatctctgtggaaggaagaaaggatattgtttgtttttttcccttttatttttaggatattgtttggaaagtaacacggggaaactttagaaatgctgttttctttttcttgatccttgatacatacatattttgtatgtctatacacttcacactttatataatacctcaaaaataaaaatatgaaaacagtacactgttgtaggttggtcaggaaagggaatgattgtggcttggacctgactatgagaagtagaaataatcagaaaaatcagaaatgattgcattggaagatcattcgaaggtagtattagtaagatttgctgatgagagtaatctagaaagtgaaagacagcataaagattgcagcttttttgttaactttaggactggtggatggttggtgtcatttactaaaatggggaggatttgaggtgaaaaaattttaggtgaagagaataatgctgagttttaggcaactattaaaatgtccattctgtagattagaggtgatgtcaggacataaatgaggttaatgtaatattacatattgatagaggaataggtcaatagagaagatacaaaagagtggttaggtgcatagatttttgaaatcagttaaattagtttttgatacttgatgtgtgacaggggaaactgtgtaagctgtacttgttatttctttgtaaaatgtcttagataataaaactaaatcataaagtagatattggtttaaaggatgtatacattgtcccttttacattgtaagcattcaataagaactagctgcggatgtaattttttttaaaaaagtccaaaagcagctatgggcagttgacaaaagaaaatgtaatgactacgtaacttgcgaatctgtttaccctcacttgcaaataaaataagtgcaaataaagcaa

SEQ ID NO: 125095 - DNA, 5953 bp, Homo sapiens
  Payload ID: 4559
  Gene Symbol: DCAF5
  Gene Name: DDB1 and CUL4 associated factor 5
  Uniprot ID: Q96JK2
  ENST ID: ENST00000341516
  CDS Start-End: 149-2977
tgtctgcacacctcgctctgcctgccatggctggttaaagaaccatccggatcgcagcgcggggggagggccgggtggggggagcagcggccgcgcgtgaggccgagggaggggcggcggcgcgagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaatacgatcactcagtgtgtgtttctcttccccttcttagtcagcacacccagtcctttattttattctattctatttattttattttaataagtacttagcctcttctgacttctcaaaggacaatcggatacatatcttcctgaaaagaagtagttaaagttcccttgggaactagctacttggtagttacaattcccaaatgcagaacttggtcttttcatgttaaaagccttaatctcatttgggtactcaaaagagaaatcagagtttattctggttaacttgagaagccaagaaagatcatttttagcaagtatgccttccatccttggcagaggcttcccagcatcctaggctcagcttaccgggtgataggccccataagacacacacatgagcagggtgagaaatgcttgctttatagctgctccaccctcatctccagagattttgtgtctatggttgtgggtctggaaacctggcaggaaccacttctagagtacctttgcctaaactcttttagaattgaggccccaactttgatggcacatttaatacccaatttcttccataatagatatttttaatagcaggacagatggcactgattagatcaagaactatttggaagtgcctcttatgtttttttcctgcattctgtacataaagttttaagtggcaggtccagatatgtaaaatcatttctctctattttccagctggttttgttaatgattctctaggacagcaggtaaatgagttaagttgttggcttggggcaagtgaagtttgtgactatgcttgatttaataagctgagagtctcttgtttgtctgtcaaggtgccttcctctgctgaagccttacctccttctcacccagtaacggttaactcttctcttgtgtatatgcaaataaacctattattcacttctcacgtcttcctcttctcttccagggaagacttggttgctta

SEQ ID NO: 125096 - DNA, 2837 bp, Homo sapiens
  Payload ID: 4559
  Gene Symbol: DCAF5
  Gene Name: DDB1 and CUL4 associated factor 5
  ENST ID: ENST00000389997
  CDS Start-End: 6-986
ccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagcatcacaactggaaatggagagcccaagctgtgagtttccagccttttctgagtctcaccaggaatggagatgctgatgttgacttaaagctggcagtttaagaatatacttggccttcttgcacctttctgtcttaaccatagaagttctgaagtgtcagtgaccagttgggctaatctgggtcaccaagccgaggaaagacaaatgggaagaaagacaaatctaaggaaagactgatcaaataaacaaatagaattttttattctcaagcacaacaaatcttattgctatttcacatatagattgggaaaaagaaaaaccttagtctctcgctaatgtttagtgttcttatctttgggtcaactatgtcaaattttgacttaaaattcttatatgctgtaccccacctctttagagttatttttggcataaaagaaatataaaagaggcataaaagaaaaatttctttgagaaactggcaagacctcgctttttgaagtaaaagctaggatttttctccttagatgggggttgctagaggcttcctaatgtcatagtttaaggattagtagatgtaataggagccgaataaatgcctgttgaattgtcttgcgtgtagatagatgagaatgttcttttaagttttctgaactagagatttcctctcttataaatagagactatatatccaaattcagaatttatactcatgttggagtcttagggcctacttagctgagatccatactggagaccactaggtggcctcagtgatgtctccttggggtgcccacagtacctgaatgacttaatttgtatatacctgtatggcactgcagggaatttgtttcttgggtgggaagaaacagtttctataggcgatcagactctcaatagaacagatatacagaatggttgatttagctttgtctggctgtggaaatgacaatcaagtctctccctctcttccttttttccttctttctttgcttttgttgatttcctatcctttgtcaacttcttatgcatgtaattcttgttttgttgaataatagagcatgcagtgaaggtgatattaatagtttactaggctttatttccagaaaccagaggctgagggaaaggtgattttcttcaggttgtgtttagcaacaaagcctatcttcatggaccttagaagacccagaacaaagacctctagccaacatgtaagcacctagaccatggtttcccatccttatcattgttaacattttggctagatagttctttgttgtgtggagctgtcctatgcattataagatggttagcagtatccctagcctcttcctactagaagccggtaatatcatcctaagttatcctccaggcaaccaaaaatgtctccagacattgtcccctggggggaaaattgcccctggttgagaacctgtgatccggattataattacccattttgctcagatgcattggggcaggtattgtcataggcagagccacagaaggtattttgtgatagtcctaggtatatacatcaaagatatcattgtttctgtctttcagtttatatataattataaaagtattgaatggcttttgatttttctctatttagatttgactaatttattatttgtgacttgtcctatgggaagagttttatgggtattttattctctctgacagacaagacttctttttggctggggtaagtggttttccttgaaagaagatgcaaagtcattgaatctaactttgggtcagttaacagagttaaagtcttaaaagtctgttcatattcctgaaatagttagaggtatataaaatacagagatttatatttggcttttttgttgactccttagggactaagaaatgtagctaattcatcattgtcttgtctccaaatcctggcacacagtgagaacacaataaaaatttgttgaagtaaa

SEQ ID NO: 125097 - DNA, 759 bp, Homo sapiens
  Payload ID: 4559
  Gene Symbol: DCAF5
  Gene Name: DDB1 and CUL4 associated factor 5
  ENST ID: ENST00000554681
  CDS Start-End: 130-759
gcggccgcgcgtgaggccgagggaggggcggcggcgcgagcggcggcggcggcggttccagcatgaagaggagagctggcctggggggcagcatgaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccag

SEQ ID NO: 125098 - DNA, 4803 bp, Homo sapiens
  Payload ID: 4559
  Gene Symbol: DCAF5
  Gene Name: DDB1 and CUL4 associated factor 5
  Uniprot ID: Q96JK2
  ENST ID: ENST00000554215
  CDS Start-End: 219-2801
gaggggaaggagaggatgtcttctataaaaaagacctaaaatggttgacagctccttaattcgctttatcccaagtgcaaagtgatctctcctgatgcctgccctgaaagtgtaggtcggggaggggggcgaggttaccgctctacaaagtttgacggcaaactcttcctccgcgtactttaaaaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaaattgtttagtgaatacagaggaaaggaaaaacaagtattaaaggcacatgaaaccagggcctgaaattttgtgtctgatgctgctcccttctatccaacattcaacaacgggtctgaatgtctagctggccattggcttgtgctgtgttaagaaaggggaaaaaaaaataacccaagtgactcctttctagtgagacgtgagcgtagtgtgccgcgcaaggctctgtggaagtaaatctttgttgagacgttcgacttgttcttgtgtacgcacaatggcacgtgtgcgcttattgtctcataagaccttccttttagttctccatcagaaaggacctatgaatttgtactttttgccatctcaccctgtttacatgccataggtgttctggtctggatgatgggtgcctgttaaatcaggttgtgctgccagtgagttgtagatttatgctggaagaatggagaatggaaacaggccttcagcccattggctgcgctggagaggaaagcatggttcctttcttaaagaaatcttccatgttttctctaagtaacacttctttattgagcatttaatgtggacatactataaaaaagaatttttaatgctaatgagaggtttagcacttaagatcagattcaagagaatatagattcctgataaatttcactgtttgcaaattgagcagtgctgcaacatgtactgtatgaaggccataaaatagagctagtcatggataacagactttaaccagttaggtgctagatcctaagaggcactcacaaggccagcaggtgcttccttggctcccatgatcgatcgaggcatagtgaaagaagggcaaagacagctttccagagctttgtgctcaggctactaaagtagttgttataggtgtgttaacgaagaagcttagtgaggagcagaatgtggtactatattcatttaactcaacccagaaccattggtcagaattggtgggactggcatcttccctcagacttgcagttgatagaggctgtggtgttctcactagactttgcagagcagtaggcatctcaaggtaacagattcttattgagtaggtctattaggagtcagaaggtgttggggaggagtctctggcttatgactcctggttcccattagtcttaagtcttctggttcccataaaagactcagttttattgaggtagatacaggtttagaagagaaaagagcaacagattttcagcgttgcagtcactcggttatctatgaagggttgtgcaaaacaggaaggtctgggaatgaccagatatcttgttggcataaatgttatgaaaaggcagaatactggcaagaaatgaggaagagagagaaaaacaatataactttcttgagtgcaaaggtgctagacaactaggagcccagctgggattggtgtagggagggccgaacgctgactagtgtggcctcactgccccaggcttcctttcagaggaaggcctgtcctgctggaactggagccaaggggaggctgcctatgaaggcagaagatgtggatgaattcaggcactgggggtgggggggttatttataaacacaaggtggttggtttaagccaaaaggagataccatcctgataagctctgtgaaagagaagatgtgcctggtgtgtgtaatgcggctggggtatgaaaacactgagaaggagatgaaggagtgtgtgtagcatgggggtgtgtacaacttaacacctggacttttactgggggagtgggaaagtgattctgtaaccaacattagaattactttggatttgtaatcagattggttctatgatttgtctttgactattcacagataattgtaaatgctggttttataagcccaagtcattttacatttgcttttccaaaatgtattaaattggaattttttaatcctttatatacaaaaaaaata

SEQ ID NO: 125099 - DNA, 2883 bp, Homo sapiens
  Payload ID: 4559
  Gene Symbol: DCAF5
  Gene Name: DDB1 and CUL4 associated factor 5
  Uniprot ID: Q96JK2
  ENST ID: ENST00000557386
  CDS Start-End: 26-2851
gagcggcggcggcggcggttccagcatgaagaggagagctggcctggggggcagcatgaggtcagtggtgggcttcttgtcccagcggggcttgcatggggaccccctgctcactcaggactttcagaggagacgcctgcggggctgcagaaacctctacaagaaggacctcctcggccacttcggctgtgtcaatgccattgaattctccaacaatggaggccagtggctggtctcaggaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaa

SEQ ID NO: 125100 - DNA, 2791 bp, Homo sapiens
  Payload ID: 4559
  Gene Symbol: DCAF5
  Gene Name: DDB1 and CUL4 associated factor 5
  Uniprot ID: Q96JK2
  ENST ID: ENST00000556847
  CDS Start-End: 154-2736
attgcagggggaggggaaggagaggatgtcttctataaaaaagacctaaaatggttgacagctccttaattcgctttatcccaagtgcaaagtgatctctcctgatgcctgccctgaaagtgaggagatgaccgccgggttctgctatggcacatggaacaagccatccactccagggtcaagcccatacagctgaaaggagagcaccattccaacattttttgcctggctttcaacagtgggaacactaaagtgttctctggaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatccccacacctacatgatctgctcttctggtgtagaaaagattatcaagatctggagcccatacaagcagccaggatgtactggagacctcgacggtcggattgaggacgattcccgctgcctctatacccatgaagagtacatcagccttgtgctgaacagtgggagtggcctgtcgcatgactacgccaaccagtcggtccaggaagacccccggatgatggccttctttgactcactggtacgccgagagatcgagggctggagctctgactcagacagtgacctcagtgagagtactatcctccaactgcacgctggggtcagcgagcgctcaggctacactgactcagagtcttcggcctcattgcctcgctccccgcctcccacagtagatgagtctgccgacaacgccttccacctggggcccctgcgggtcaccaccacaaacacagtagcctcaactccaccaacacccacgtgtgaggatgcagcctctcgccagcagcgtctgtctgctctgcggcgctaccaagacaaacgcctcctggccctttccaatgagtccgattctgaggagaatgtctgtgaggtggaactagacacagatctctttccccggccacggtcacccagccccgaagatgaatccagcagttccagcagctctagcagctctgaggatgaggaggagctgaatgaacgccgagcctctacctggcagcggaatgccatgcggcgccgacagaagacaacccgagaagacaagcccagtgccccaatcaagcccaccaacacttacattggagaagacaactatgattacccccagatcaaagtggatgacctctcctcctccccaacctcgtcccctgagcggagcacttccacgctagagattcaaccaagccgggcatcaccaacttctgacatagaatcagttgagcgaaaaatttataaagcttacaagtggctccgctactcttatatctcctactcaaataacaaagatggagagacctccttggtgaccggggaggcagatgaagggagagcaggaaccagccacaaagacaacccagccccttcttccagtaaggaagcctgtctaaacatagcaatggcccagaggaaccaggacctgccacctgaaggctgcagcaaggacacttttaaagaagagactcctagaactcccagcaatggcccaggccatgagcacagcagccatgcttgggcagaggtgccagagggtacctctcaggacactggcaatagcggctctgtagagcacccttttgaaaccaagaagctcaatggaaaggccctgagcagtcgggctgaggagccgccttctcctcctgtccccaaggcatctggctccactctcaacagcgggtctggcaactgtcccaggacccagtctgatgacagtgaggagaggagcctcgaaaccatctgtgccaaccacaacaatggacgcttacaccctcgtccccctcaccctcacaataacgggcagaacttgggggagctggaggtggtggcctactcttccccaggacactcagacactgaccgtgataactcgtccctgacagggacactcctacacaaagattgttgcgggtctgaaatggcctgtgagacccccaatgctggaacaagagaggaccccactgacaccccagccacagatagtagcagggctgttcatggccacagtggcctcaaaaggcaacgaattgaattggaagatacagattcagagaattcctcctcagagaagaaattaaaaacatgataaatacaaagggaaaacaaaaagctacaaaagtagccttacaaaaaaaaaaaaa

SEQ ID NO: 125101 - DNA, 728 bp, Homo sapiens
  Payload ID: 4559
  Gene Symbol: DCAF5
  Gene Name: DDB1 and CUL4 associated factor 5
  ENST ID: ENST00000556111
  CDS Start-End: 159-410
ggcggcggcggcggttccagcatgaagaggagagctggcctggggggcagcatgaggcaatgatgagcaagttatcctccatgatgttgaaagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaaacctgtccctccaaagtgccatgagtgtacgattcaacagcaacgggacccagctcctggccctgaggcgacgcctgccccctgtgctctatgacatccattcccgcctgcctgtgtttcagtttgacaatcagggttacttcaactcatgcaccatgaaaagctgctgttttgcaggagatcgtgaccagtatatcctttcgggctctgatgacttcaacctgtacatgtggagaattcctgcagatccagaagcaggtggcattggtagggtggtcaacggagccttcatggtgctgaaagggcatcgatctattgttaaccaagtccgatttaatcccc

SEQ ID NO: 125102 - DNA, 3186 bp, Homo sapiens
  Payload ID: 4560
  Gene Symbol: DCAF6
  Gene Name: DDB1 and CUL4 associated factor 6
  Uniprot ID: Q58WW2
  ENST ID: ENST00000312263
  CDS Start-End: 205-2787
agagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaaga

SEQ ID NO: 125103 - DNA, 3349 bp, Homo sapiens
  Payload ID: 4560
  Gene Symbol: DCAF6
  Gene Name: DDB1 and CUL4 associated factor 6
  Uniprot ID: Q58WW2
  ENST ID: ENST00000367840
  CDS Start-End: 95-2950
gccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcagattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagatttaatatcagaggaacaacaataggtgatagaataatgagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaaga

SEQ ID NO: 125104 - DNA, 3302 bp, Homo sapiens
  Payload ID: 4560
  Gene Symbol: DCAF6
  Gene Name: DDB1 and CUL4 associated factor 6
  Uniprot ID: Q58WW2
  ENST ID: ENST00000367843
  CDS Start-End: 252-2894
gaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaa

SEQ ID NO: 125105 - DNA, 3522 bp, Homo sapiens
  Payload ID: 4560
  Gene Symbol: DCAF6
  Gene Name: DDB1 and CUL4 associated factor 6
  Uniprot ID: Q58WW2
  ENST ID: ENST00000432587
  CDS Start-End: 354-3116
atctcgcgagaaagggttggcggggagggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctgaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcagattctccttcttctgtggttaacaaacagctcggatccatgtcacttgacgagcaacaggataacaataatgaaaagctgagccccaaaccagggacaggtgaaccagttttaagtttgcactacagcacagaaggaacaactacaagcacaataaaactgaactttacagatgaatggagcagtatagcatcaagttctagaggaattgggagccattgcaaatctgagggtcaggaggaatctttcgtcccacagagctcagtgcaaccaccagaaggagacagtgaaacaaaagctcctgaagaatcatcagaggatgtgacaaaatatcaggaaggagtatctgcagaaaacccagttgagaaccatatcaatataacacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgatagatttaatatcagaggaacaacaataggtgatagaataatgagacgctctgctgttgcccgtattcaggagttcttcagacggagaaaagaaaggaaagaaatggaagaattggatactttgaacattagaaggccgctagtaaaaatggtttataaaggccatcgcaactccaggacaatgataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaattttagcctcatctggcatagattatgacataaagatctggtcaccattagaagagtcaaggatttttaaccgaaaacttgctgatgaagttataactcgaaacgaactcatgctggaagaaactagaaacaccattacagttccagcctctttcatgttgaggatgttggcttcacttaatcatatccgagctgaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctg

SEQ ID NO: 125106 - DNA, 2803 bp, Homo sapiens
  Payload ID: 4560
  Gene Symbol: DCAF6
  Gene Name: DDB1 and CUL4 associated factor 6
  ENST ID: ENST00000470721
  CDS Start-End: 240-1658
gctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgctacctgggaagaagagaatttatccaaagattaaaacttgaagcaacccttaatgtgcatgatggttgtgttaatacaatctgttggaatgacactggagaatatattttatctggctcagatgacaccaaattagtaattagtaatccttacagcagaaaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgagattatgactgtacccaatgacccttacacttttctctcttgtggtgaagatggaactgttaggtggtttgatacacgcatcaaaactagctgcacaaaagaagattgtaaagatgatattttaattaactgtcgacgtgctgccacgtctgttgctatttgcccaccaataccatattaccttgctgttggttgttctgacagctcagtacgaatatatgatcggcgaatgctgggcacaagagctacagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagagttgcgacaaccaccagttaagcgtttgagacttcgtggtgattggtcagatactggacccagagcaaggccggagagtgaacgagaacgagatggagagcagagtcccaatgtgtcattgatgcagagaatgtctgatatgttatcaagatggtttgaagaagcaagtgaggttgcacaaagcaatagaggacgaggaagatctcgacccagaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctggtcccctgaagtcatgggttgctggctcctgctcagagtgacagcaccctgtggagtctgctggtactgacctaaccaccacagagccccactggagcatggagccagcctagagagggtcagattctccttcttctgtggttaacaaacagctcggatccatgtcacttgacgagcaacagggtgcgtgcaacaggagatgcgctatgcccatccatccatagctttattgcaatgcatatactaagctctctcacacctttcgtagcatttcattttgattatggtcttatagtcagtattttgtggaccaaattacaataggtggtattgtacataaaaggtctttttggcctatacagattattttctatgtaagctcatttctcactttggcccttgatgccaactttgaactctctccctataacaaaattataatggatacaaactatatccattttttaaattctaggtatctgtcataaaattgtgtagaactgtgggtgtgaggttaatactacctcgttgcttatgtaggataagttatttaaacacagtgatattctatattactagattgctttagtaatgatacttggttttatgtctcacttatctggtagccaaattcctggtagctttaactaaagactatagttacgaacccagaggtaagctcaaaagctgtcagtcagaagctcccacttccacttgtacttttcaatgtgggaaaggtatagaatcaatctccaagccttgaatagagcctgatgaaatgaacgcgttacttatttatcaggctttattactagcgatcaaatatagcacagagaaggattagtagaggaagacattctgacatgaagggacatctgaaaaggctggagataggaagactaaaaactaaaaaggctatttagtgttagcgcaaatgttttactatctcacctcagaatttaatgaagtattttaaatatattgtgacaaagtgtgataagtaatcttagttaagtctttaagaatgatttaacacgatattcactttctctatttaaaaaggcagatagctggacgtggtggcacacgcctgtaatcccagctacttgggaggctggggcgggaggatcacttgaacccagaaatttgagaccagcctggtcaatatagcgagaccccgtctctt

SEQ ID NO: 125107 - DNA, 1354 bp, Homo sapiens
  Payload ID: 4561
  Gene Symbol: DCAF7
  Gene Name: DDB1 and CUL4 associated factor 7
  Uniprot ID: P61962
  ENST ID: ENST00000431926
  CDS Start-End: 197-1225
ccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaacctcctgtataagaagtaccgtattttctgcccatcatactttgtaataaaacttgaacatgta

SEQ ID NO: 125108 - DNA, 1220 bp, Homo sapiens
  Payload ID: 4561
  Gene Symbol: DCAF7
  Gene Name: DDB1 and CUL4 associated factor 7
  Uniprot ID: P61962
  ENST ID: ENST00000415273
  CDS Start-End: 179-607
gaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctg

SEQ ID NO: 125109 - DNA, 751 bp, Homo sapiens
  Payload ID: 4561
  Gene Symbol: DCAF7
  Gene Name: DDB1 and CUL4 associated factor 7
  ENST ID: ENST00000615512
  CDS Start-End: 132-751
cccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgc

SEQ ID NO: 125110 - DNA, 6340 bp, Homo sapiens
  Payload ID: 4561
  Gene Symbol: DCAF7
  Gene Name: DDB1 and CUL4 associated factor 7
  Uniprot ID: P61962
  ENST ID: ENST00000614556
  CDS Start-End: 218-1246
aaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggttcagcttgttggtttagatgaggagagttcagagtttatttgcagaaacacctttgaccacccataccccaccacaaagctcatgtggatccctgacacaaaaggcgtctatccagacctactggcaacaagcggtgactatctccgtgtgtggagggttggtgaaacagagaccaggctggagtgtttgctaaacaataataagaactctgatttctgtgctcccctgacctcctttgactggaatgaggtggatccttatcttttaggtacctcaagcattgatacgacatgcaccatctgggggctggagacagggcaggtgttagggcgagtgaatctcgtgtctggccacgtgaagacccagctgatcgcccatgacaaagaggtctatgatattgcatttagccgggccgggggtggcagggacatgtttgcctctgtgggtgctgatggctcggtgcggatgtttgacctccgccatctagaacacagcaccatcatttacgaagacccacagcatcacccactgcttcgcctctgctggaacaagcaggaccctaactacctggccaccatggccatggatggaatggaggtggtgattctagatgtccgggttccctgcacacctgtcgccaggttaaacaaccatcgagcatgtgtcaatggcattgcttgggccccacattcatcctgccacatctgcactgcagcggatgaccaccaggctctcatctgggacatccagcaaatgccccgagccattgaggaccctatcctggcctacacagctgaaggagagatcaacaatgtgcagtgggcatcaactcagcccgactggatcgccatctgctacaacaactgcctggagatactcagagtgtagtgttggtggcgctgtgcccacgaggcaggggcttttgtatttcctgcctctgccccacccccaaagtaagaagaaacatgtttccagtggccagtatgtctttcattgctttgcacccactgttaccagaagctgctctaggagttcctggccagtcaccccatcgccctctgtggcagactcagtgctgtgtggcgcctcctcagcccagggctgagttttaagattttctctcctttcctcttctcctttggttcctcaattaaaaaatgtgtgtatatttgtttgtcaggcgttgtgttgaggagcagttcacgcactggctgtgtctattcctctgcccaggtgtctctgtttgctgcccaaggcagcagttcatgtctcgtccatgtccatgttcgtgttagcacttacgtgggaacaaataccaatttgtcttttctcctagtatcagtgtgtttaacaaattttaactttgtatatttgttatctatcaggctaatttttttatgaaaagaattttactctcctgcttcatttctttgtcttatagtcctccctctttgcaccttcttctcttccctcagtgcctggagctggtactgggcccctggccccatgagcagtttgccttcttgagtcactgcctgtgtagtacatacctgaccgggagtccaaaccaccttggtgctctgaagtccactgactcatcacacctttcttagcctggctcctctcaagggcattctgggcttgtaaacagacataggaagcctctgtttaccctgaagcaccactgtccagcccattggttcccactggcagcatggtagagctgagagaaacaggctctcagggtacctgacttgaggggaatcgtttcatgaagctgaacttcaagcatatttccagtacattctttcagagtctgtttttccatccaaatataagccccaggccattccacttagtgtcttttcaatgataggcaagaatgatatctgagttgaacttcggtgcttctgttgtttgagtttactgtgcctggtggtatattgggcattctttggattgagtgttctgaggtgagagagtcttcccgaggcatcctgtctgtgcttccaaccctgaacaagaccttacatgagagatggactgatggactgcggcaatcctgggctgtcaagtggatagatagttaaaaagcattatactgtgggtaatgaaaagggaggaaaaaaaaagaaggaaaaggaattatagacccccagggtcagccagttaagagctctacccacacctgtcaacccctctctcccccagtttaggttctgagcagtattggacttgtagcctgcagttgtcttttgacttgcaggccgcaggtgtctttctgttatgtgaatgagttccatggaggggcatatgtgtgattccaccgttagatgagcccttggggcaggcagtttgggatgtgctcttgggggaaagttggctgtttccttgcgctctgctcctacccgaaggtttttaagtccctctgaattgctcatctgagattagtagagtagcaggcctgaaggatgatggttttgtcctctttggttctcacctgcttgagaagtaaaacagtaactttgttcttctgggcccttaagcttttttggttaagtcttccttttcagaagtagatgtcattatatgccaaaagtctagctctttgctttaccatacagggacctgtcccaaagaaaaaggctctttttttagccagcatatttccccttctacccttttactttgttgttctgattttaggactctggctggccatgtgcttgtggttgcctctcctgcatttgccactggatttgcactgcatcgtttggagatacaaagcgagcagttcttggtcagaaccctcctctgcttttcattgtgtttgataatggttactgggtccttctctcaagggtagcaaggccaagctgatggctgcttgtttaggaggccatcagttccttcctgtggagaagggtctgaaatggaagtcagtggtagaaggggctggtctgctgggcagggcttacatccactgagttctaagattcctttcctgatctgcacctacgcctggtctgtatggtggaatttgtcagctggaactcagaaacaacaacttgaaaaaaaaataataattagaacatatttgcataagatagctatttactctggaaaccaacaacttttgagatttcccttgccctgtggacgcccagctcctgtcatccttccttaggtcctgcagtacagtcttcccctgaatgccaccggggacccagggggactccacccccctaagcaagcacacacatactcacagttgatgagttgctggtctttgagtcccagctctcttaccctccctttactccaccagcccgacgacccatgactgaggaggggatttctacagtctcaggatttagaaagtctgtaagccatccatgctccagaaagcaccgatctgttgtagttgcaaaaacaactctgtaatttgttgaggttctcaaactgacagccagcgagactgggtgggaggccctggatctgttctccctgactgcgggaggagcagccactaggactttagcaggaagcccacatggaggctccgccaggctgtggcccagctggtgatggcccttttgctcctggcagcctgaggcacagctgcctgtattgtcctcatctgttctgactgaaggatggaggtgctgaataaattaggcctcaggcctctaccaccagagagctggagaatgggtccacgtcattcaaggacctgaattttttatgctcaggagcattggaatcctcttcttccagggaggaattagcctgcaaggttaggacttgaagagggaaggtatttaataactgggcgaggatgggtgtggtggctcacacctgtaatcccagcattttgggaggctgaggtggccagatcccaaggtcagaagatcgagaccatcctggctaacatggtgaaaccccatctctactaaaaatacaaaaaaaaattagccgggggtggtggcgggtacctgtagtcctagctacttgggaggctgaggcaggagaatggcgtgaacctgggaggtggagcttgcagtgagccaagatcgtgccactgcactccagcctgggcgacagagcaagactccgtctcaaaaaataaaaaaaaaaaaaaaataggtgaaaattccttataaatccaggattggctctgagagaactggctaagattcaggaagaaacaaaaaattcagaatcctacaaggttttgatgacaattagggccaaaattttaggaggagatgtaggatgcaggagaaaattaaagtgttttctttatatcagaggaggaaatagtagaggtcagtgaaggtctggggtagggaaacattcagactgtccattgcatggctgtggagtgagactgcccttagcctgggtcagccttcctgggccataaattgggcatccgtgatgctaggtaactgtgggaacaaaatgacagcttagagcagccatgggtgatgtttggtggtaaaaaacctacaggcgtttggggtcccatgattgttccagaccatgactcttcctggttgtgggtttgttacagagcaggagaagcagaggttatgacagttatgcagactttccccctcctttttctcttttctcttccccttgcttttccactgtttcttcctgctgccacctgggccttgaattcctgggctgtgaagacatgtagcagctgcagggtttaccacacgtgggagggcagcccagtactgtccctctgccttccccactttgagaatatggcagcccctttcattcctggcttggggtaggggagaccattgaagtagaagcctcaaagcagacttttccctttactgtgtgtactccaggacgaagaaggaagatcatgcttgatacttagattggttttcccagggaagagggcggagcagagcaaagtcactgtgaaccctgggccaggccctggctgggccagctcctgagagcgtctcgtgttgcagacccttgcccacttcacccacctgcaccttctccccctctcacagtgtcactgctgctaatggtcaaagtcaaatgtgtggccacatgggatgggccaggtcctctcaggctactttctggatgtcatttttaaaatatggaaacatgcaggtgccttcccaaagaggcttggactggtatatccaacgagaaacaaataagctaaagaaagtttaaactcaagaagaaagatgttgacagtctatgtaacagctggaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttccttccccaccccacccagagtgaatttgtagcatgattgtataaacctctatgtagaaaatggagatttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttcaccctttcattctgtttcagcctcctgtataagaagtaccgtattttctgcccatcatactttgtaataaaacttgaacatgta

SEQ ID NO: 125111 - DNA, 3972 bp, Homo sapiens
  Payload ID: 4562
  Gene Symbol: DCAF8
  Gene Name: DDB1 and CUL4 associated factor 8
  Uniprot ID: Q5TAQ9
  ENST ID: ENST00000326837
  CDS Start-End: 302-2095
gcggtggtggtggcggccgctggccagtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccgtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 125112 - DNA, 4106 bp, Homo sapiens
  Payload ID: 4562
  Gene Symbol: DCAF8
  Gene Name: DDB1 and CUL4 associated factor 8
  Uniprot ID: Q5TAQ9
  ENST ID: ENST00000368073
  CDS Start-End: 436-2229
agtgtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 125113 - DNA, 3824 bp, Homo sapiens
  Payload ID: 4562
  Gene Symbol: DCAF8
  Gene Name: DDB1 and CUL4 associated factor 8
  Uniprot ID: Q5TAQ9
  ENST ID: ENST00000368074
  CDS Start-End: 154-1947
gcaggcgcaagcgcagagagcggaggcggtggtggtggcggccgctggccagttccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctggtgaacagtgagtccaaagcaaacatcacctgtcttgtgtacagccacgacggcacagagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatctcctacctctccttaagtcttgtagggggttccaaggatggctcttctaaccagaggctggcctgtctttaaaacttaactactttagggtggtgccaccactgcagactattgtggtactttgtgacagaagacatgtacacacacaccacacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgct

SEQ ID NO: 125114 - DNA, 517 bp, Homo sapiens
  Payload ID: 4562
  Gene Symbol: DCAF8
  Gene Name: DDB1 and CUL4 associated factor 8
  ENST ID: ENST00000407642
  CDS Start-End: 200-517
gtaagatggcggcggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaa

SEQ ID NO: 125115 - DNA, 439 bp, Homo sapiens
  Payload ID: 4562
  Gene Symbol: DCAF8
  Gene Name: DDB1 and CUL4 associated factor 8
  ENST ID: ENST00000419626
  CDS Start-End: 318-439
gctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagt

SEQ ID NO: 125116 - DNA, 501 bp, Homo sapiens
  Payload ID: 4562
  Gene Symbol: DCAF8
  Gene Name: DDB1 and CUL4 associated factor 8
  ENST ID: ENST00000440682
  CDS Start-End: 173-501
gcaaacggggccggaaagcgtggcagcgcaggcgcaagcgcagagagcggaggcggtggtggtggcggccgctggccagttgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggagga

SEQ ID NO: 125117 - DNA, 728 bp, Homo sapiens
  Payload ID: 4562
  Gene Symbol: DCAF8
  Gene Name: DDB1 and CUL4 associated factor 8
  ENST ID: ENST00000447377
  CDS Start-End: 93-728
aaagcgtggcagcgcaggcgcaagcgcagagagcggaggcggtggtggtggcggccgctggccagtgctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagc

SEQ ID NO: 125118 - DNA, 1426 bp, Homo sapiens
  Payload ID: 4562
  Gene Symbol: DCAF8
  Gene Name: DDB1 and CUL4 associated factor 8
  Uniprot ID: Q5TAQ9
  ENST ID: ENST00000475733
  CDS Start-End: 229-1050
cggcgttggtggtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggtgaggcaagggagcataatagcaactgagagaatcaggcatgagttagagaaatctgaactgcagcatggattgggagctgatagtgagttattgtaggaattacatatcgggacatggccctactttggctcccctaatgacctaaatacactgaaagactcttggcaaccctagattccttgagcatgtggactgttggaagcctcataggtagggtgcatgcagcttattaaatgtgtgctggtaggaggcagtgtagtataagcacaggctcttgaaccaaactgcctgagttcaaatcctagcccttctgcttactagctcagtgatcttggccaagttattttacctttgtcttcagtttatctgtaaaatgggactaataacacatagggttatgaggattaagtaacaatagaagctaagcagttagaactgtgactggtacttaataaacatttgataaatgtta

SEQ ID NO: 125119 - DNA, 2277 bp, Homo sapiens
  Payload ID: 4562
  Gene Symbol: DCAF8
  Gene Name: DDB1 and CUL4 associated factor 8
  ENST ID: ENST00000461888
  CDS Start-End: 184-1437
gtcgcaaacggggccggaaagcgtggcagcgcaggcgcaagcgcagagagcggaggcggtggtggtggcggccgctggccagttccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggccaagtttcttcctaacagtggtgattctactctggccatgtgtgcccgtgacgggcaggttcgagtagcagaactgtctgccacacagtgttgcaagaatacaaaacgtgtggcccagcacaagggagcgtcccacaagttggcactggaaccagactctccctgtacgttcttatctgcaggtgaagatgcagttgttttcaccattgacctgagacaagaccgcccagcgtcgaaactggtggtgacaaaagagaaagagaagaaagtggggctgtatacgatctatgtgaatcctgccaatacccaccagtttgcagtgggtggacgagatcagtttgtaaggatttatgaccagaggaaaattgatgagaatgagaacaatggagtactcaagaagttctgtcctcatcacctgagctcctggccagttacaatgatgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtgggacaagggttgggggtggtatcagaggacagccccttagtctcccaagagcactttgatgcttgatcccattctctacattcccccagcccagtcatctaaggccagagctcttttctctgctcaggcattattgacaggataagtcctggcattcagacaggtctggtgaagtgaccaggtactctggcccagaagttctctgtcggctccccccgcaggctccaattcaggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaa

SEQ ID NO: 125120 - DNA, 573 bp, Homo sapiens
  Payload ID: 4562
  Gene Symbol: DCAF8
  Gene Name: DDB1 and CUL4 associated factor 8
  ENST ID: ENST00000473382
  CDS Start-End: 1-244
gttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggt

SEQ ID NO: 125121 - DNA, 919 bp, Homo sapiens
  Payload ID: 4562
  Gene Symbol: DCAF8
  Gene Name: DDB1 and CUL4 associated factor 8
  ENST ID: ENST00000495887
  CDS Start-End: 545-919
ttagaacggtcccatttggtccctgttagttggaaagcatctggtggcttgaatttctgactcatgattgttactggagtctctgtaaacaaaccggcactagcgctatcacattctctccgggatttccccccctgctctgtggcttcttgttgagaggttgtttggttatggtttagcgttgaaaagattcaggttatccttttaaatgactttacgttttagtggagctgggagattacttgcctggcttctaatcttcatgttggttcattttatttccatatgtgtgtgggttatttgttcagtaattagaattagataaagtattctgcttttaagtagttttgagaaggcctaaaaatactaaagtgtattcataaatatttttattatgttcagtagaagacacacctttgccatgtaaattttaacttttctcagtccttcagtgaatctacagacctattttctcaggagctcagcctggccttacttcagtgataaaaggaggaaaggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacct

SEQ ID NO: 125122 - DNA, 876 bp, Homo sapiens
  Payload ID: 4562
  Gene Symbol: DCAF8
  Gene Name: DDB1 and CUL4 associated factor 8
  ENST ID: ENST00000490368
  CDS Start-End: 1-329
atgaagacatttacctcttcaactcctctcacagtgatggggcccagtatgttaagagatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggcgtgagagatgcagggctgaatgccctctcccaggccagcatttgtccattctccaaaagcattctgcaggccagtttgcttttagctcagccaatgccagggtttgatgattaacccatttgcccagacaggtctggtgaagtgaccaggtactctggcccagaagttctctgtcggctccccccgcaggctccaattcaggtaaactgtcttgagccccaccctcacctgcctgtgctggcaaccagtggcctagaccatgatgtgaagatctgggcacccacagctgaagcttccactgagctgacagggttaaaagatgtgattaagaagaacaagcgggagcgggatgaagatagcttgcaccaaactgacctgtttgatagtcacatgctgtggttccttatgcatcacctgagacagagacgccatcaccggcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggacttt

SEQ ID NO: 125123 - DNA, 513 bp, Homo sapiens
  Payload ID: 4562
  Gene Symbol: DCAF8
  Gene Name: DDB1 and CUL4 associated factor 8
  ENST ID: ENST00000477163
  CDS Start-End: 1-201
agatacaagggccacagaaataatgccacagtaaaaggcgtcaatttctatggccccaagagtgagtttgtggtgagcggtagtgactgtgggcacatcttcctctgggagaaatcatcctgccagattattcagttcatggagggggacaagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaag

SEQ ID NO: 125124 - DNA, 1607 bp, Homo sapiens
  Payload ID: 4562
  Gene Symbol: DCAF8
  Gene Name: DDB1 and CUL4 associated factor 8
  Uniprot ID: Q5TAQ9
  ENST ID: ENST00000610139
  CDS Start-End: 410-1231
gtggcagtggacggggcggctgggcctggaacagtcggagcagccgctagcagaaggatgacccaagacgggaagcgggctgctgagcctcgccgattcccgtgcttgtaactgccccagccggacaccccccctcccttgacctacccggtctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcagtccttcagtgaatctacagacctattttctcaggagctcagcctggccttacttcagtgataaaaggaggaaaggctggctacagcaaacatcattcaagatgtccagcaaagggagcagcacagatggcagaacagacttagctaatggaagcctgtctagcagtccagaggagatgtctggagctgaagaggggagggagacatcctcaggcattgaagtggaggcctcagacctgagtttgagcttgactggggatgatggtggccccaaccgcaccagcacagaaagtcgaggcacagacacagagagctcaggtgaagataaggactctgacagcatggaggacactggtcattactccattaatgatgaaaatcgagtccatgaccgctcagaggaagaggaagaggaggaagaagaggaggaagaagagcagcctcggcgccgtgtacagcgcaagcgggctaaccgtgaccaggactcatcagatgatgagcgggccctagaggactgggtgtcctcagaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggtgaggcaagggagcataatagcaactgagagaatcaggcatgagttagagaaatctgaactgcagcatggattgggagctgatagtgagttattgtaggaattacatatcgggacatggccctactttggctcccctaatgacctaaatacactgaaagactcttggcaaccctagattccttgagcatgtggactgttggaagcctcataggtagggtgcatgcagcttattaaatgtgtgctggtaggaggcagtgtagtataagcacaggctcttgaaccaaactgcctgagttcaaatcctagcccttctgcttactagctcagtgatcttggccaagttattttacctttgtcttcagtttatctgtaaaatgggactaataacacatagggttatgaggattaagtaacaatagaagctaagcagttagaactgtgactggtacttaataaacatttgataaatgtta

SEQ ID NO: 125125 - DNA, 3363 bp, Homo sapiens
  Payload ID: 4563
  Gene Symbol: DCAF8L1
  Gene Name: DDB1 and CUL4 associated factor 8-like 1
  Uniprot ID: A6NGE4
  ENST ID: ENST00000441525
  CDS Start-End: 22-1824
ctacagcaaacatcgttcgagatgtcccaccaagagggcagcacaggtggcttaccagacttagtgactgaaagcctgttcagcagcccagaggagcagtctggagtagcagcggtgacggcggcctcctcagacattgaaatggcagccacagagccatcgaccggagatggtggtgataccagggatggtggtttcctgaacgatgccagcacagaaaatcaaaacacagactcagaaagttcaagtgaagacgtcgaacttgaaagcatgggtgaaggtttatttggttacccgttagtgggagaggagacagaaagggaggaggaagaagaagagatggaggaggaaggggaggaggaagaacagcctcggatgtgtccacgatgcggtggcaccaaccatgatcagtgtttgttagacgaggatcaggcgttggaggagtggatttcctcagagacatctgccctgccccgatctcgctggcaagtccttactgctcttcgccagcggcagctgggttcaagtgcccgctttgtatatgaggcctgtggggcaagaacctttgtgcagcgtttccgcctgcagtatcttcttggaagccatgccggttctgtcagtaccatacactttaaccagcgtggcacccgactggccagtagcggtgatgacttaagggtgatagtgtgggactgggtgcggcagaagccagtactgaactttgagagtggtcacgatattaatgtcatccaggctaagttctttcctaactgtggtgattccactctggccatgtgtggccatgatggacaggtacgggtagcagaactaattaatgcatcatattgcgagaatactaagcgtgtggccaagcacaggggacctgcccacgagttggctctggagccagactctccttataagttcctcacttcaggtgaagatgccgttgtgttcaccattgacctcaggcaagaccggccagcttcaaaagttgtggtaacaagagaaaatgataagaaagtcggactgtatacaatctctatgaatcctgccaatatttaccaatttgcagtgggtggacatgatcagtttgtaaggatttatgaccagaggagaattgataagaaagaaaacaatggagtactcaagaaattcactcctcatcatctggtttattgtgatttcccaacaaacatcacctgcgttgtgtacagccacgatggcacagagctcctggccagctacaatgatgaagatatttacctcttcaactcctctctcagtgatggtgctcaatatgttaagagatataaggggcacagaaataatgacacaatcaaatgtgttaatttctatggcccccggagtgagtttgtcgtgagcggtagtgattgtgggcacgtcttcttctgggagaaatcatcctcccagatcatccagttcatggagggggacagaggagatatagtaaactgtcttgaaccccacccttacctacctgtgttggcgaccagtggcctagatcagcatgtcaggatctggacacccacagctaaaactgccactgagcttactgggttaaaagatgtgattaagaagaacaagcaggagcgagatgaagacaacttgaactatacggactcgtttgacaaccgcatgcttcggttcttcgtgcgtcacctgttacagagagctcatcaacccggctggagagatcatggagctgagttcccagatgaagaagagttggatgagtcttccagcacctcagatacatccgaggaggagggccaagatcgagtgcagtgcataccatcctgaaggcctcatatccagtccagctagatgccacctaagtacactggactttaaaattcagtttgactaatttagaattgtcaattgattaacagatttgctttttgtcttctgtttttgttaccccttatatgagtgcatacacaacttatttatgcctcttttcctttgttcccttataattgacctctaaaattgcataattttgttgaaaaaattaatggccttattagatgtatctactcatttcagacattctgaaagctattactttttagttttttcattttttaccaatttattttgaagataaagttcttcagttgagttgaaaatttcataaacgtgtttattctttagaggtaaaataaggcaaaccatagttctttgaatactgacacacacatacacacagtctcagaaaaggaaaagagaagtagtgtgtagattaattcctaacacttggccacacacacacacagcttcaaaagttgtagtaacaagagagaagaataagaaagtgggactgtatacaatctctatgaatcctgccaatatttaccaattcgcagtgggtggacatgatcggtttttaaggatttatgaccagaggagaattgatgagaaagaaaacaatggagtactcaagaaattcactcttcatcatctggttaattgtgattttccaacaaacatcacctgcattgtgtacagccacgatggcacagagctcctggccagctatgcacacacacatacacacagagccttagaaaaggaaaacaagaagtagtgtgtagatgaattcctaaccagataattcatctcctcagagcaaataacttgggattatccacattttctgaatcaatatgttaataatattgattaatttgagcacactgaagctggtaagaactaaattaaatttaatcacatgacattgtttactctatgcattaaatgttcttgaagttttatggttgggaactcccacaggattacattccaggaagtcctcctggcgcaagcatctcctataagataccagataggaatataaaaatctctcatatttgaaaacatttattttaattaacttttaagaataagttgcaataaaaattgtttatacttacacataaccatttgatacagttggtagaaaaatcctatttaacatccatgcattgcttaaaatttagctgttttatgagtttgttttgaaaattgttgcaataaaaattgtttatacttacaagtgatgtagttggtagaaaaatcctatttgacatccatgcattgcttaaaatttagctgttttatgagtttgttttaaaaattgttgcagtaaaaattgtttatacttacaagtgatgtagttggtagaaaaatcctatttgacatccatggattgcttaaagttctctcagctgtcctcgagtttaaattgttttaaaaattgtcttaagctttacttaatataaatttaagttactagatgttaaattactgttcaataaaaatattcatttttatttt

SEQ ID NO: 125126 - DNA, 2295 bp, Homo sapiens
  Payload ID: 4564
  Gene Symbol: DCAF8L2
  Gene Name: DDB1 and CUL4 associated factor 8-like 2
  Uniprot ID: P0C7V8
  ENST ID: ENST00000451261
  CDS Start-End: 400-2295
tttagaagacgtcttgcactgttcaaatgcagaggaaggcgaatgactcgagtctatggttttggtatactgagcctggggctactggtgtcagcctggtggtagtgcagctcatctgatgcctggggctgcaggatcctagttggttcctgtgacagaccttgggaagctcaatctcagatgtgttttcttaattgaagaaaatcatatcacatgtgaactttctgaccatactgtggagcggtgctaataaggaggaagctgcactgttgcagaggtccattaactctttcaggacggtgtggaatcagtggggaaatctctaattgctactgacacagagcttttaggggcctggcctttgcagttccagatctactacagcaaacatcgttcaagatgtcccaccaagaaggcagcacagacggcttaccagacttagggactgaaagcctgttcagcagcccagaggagcagtctggagccgtggcggcgacagaggcctcctcagacattgacatagcgacctcagagctgagtgtgacagtgaccggagatggcagtgatagcagggatggtggattccccaacgatgccagcacagaaaatcgaagctcagaccaagaaagcgcaagtgaagacatcgaacttgagagcttggaggactttgagcatttcctcatgagtggtgaaagtttattccattaccctttagtgggagaggaggagacagaaagggaggaggaagacgaagagatacaagaggagggaggggaggaggaggaagaggaggaggaggaggaggaggaggaggaggaggaggaggaggaggaagaagaacagcctcgggcgggtccacaaggcagtggcggcaaccatgagcagtattcgttagaggaggatcaggcgctggaggagtgggtttcctcagagacatctgccctgccccgacctcgctggcaggtcgttactgctcttcaccagcggcagctgggttcacgtccccgctttgtatatgaggcctgtggggcaagagcctttgtgcagcgtttccgcctgcaatatcgtcttgcagaccatgtcggctgtgtcaatactgtacactttaaccagcgtggcacccggctggccagtagcggtgatgacctaaaggtgatagtgtgggactgggtgcggcagaggccagtactgaactttgaaagtggtcacacaaataatgtcttccaggccaagttccttcctaactgtggtgattccactctggccatgtgtgcccgtgatgggcaggtacgggtagcagagttaattaatgcatcatatttcaacaatactaagtgtgtggcccagcacaggggacctgcccacaagttggctctggagcctgactctccttataagttcctcacttcaggtgaagatgctgttgtcttcaccattgacctcagacaagaccggccagcttcaaaagttgtggtaacaagagaaaatgataagaaagtgggactgtatacaattactgtgaatcccgccaatacctaccaatttgcagtgggtggacaagatcagtttgtaaggatttatgaccagaggaaaattgataagaaagaaaacaatggcgtgctcaagaaattcactcctcatcatctggttaattgtgatttcccaacaaacatcacctgcgttgtgtacagccacgatggcacagagctgctagccagctacaatgatgacgatatttacctcttcaactcctctcacagtgatggtgctcaatacagtaagagatttaagggacacagaaataataccacagtcaaaggtgttaatttctatggccccaggagtgagtttgtagtgagcggtagtgattgcgggcacatcttcttctgggagaaatcatcctgccaaatcatccagttcctaaaggggagcagagaaggtacaataaactgtcttgaaccccacccttacctacctgtgttggcgtgcagtggcctagatcatgatgtcaagatctggacacccacagctaaagctgccactgagcttactgggttaaagaaggtgattaagaagaacaagtgggaacgagatgaagacagcttgcaccatggcagcctgtttgaccagtacatgctttggttcctcctgcgtcacgtgacgcagagaggtcgtcaccaggactggagaagtggtgaagctgaatttccagatgaagaatcggatgagtcttccagcacttcagagacatctgaggaggaggtccaagaccgagtgcagtgcatgccatcctga

SEQ ID NO: 125127 - DNA, 562 bp, Homo sapiens
  Payload ID: 4564
  Gene Symbol: DCAF8L2
  Gene Name: DDB1 and CUL4 associated factor 8-like 2
  ENST ID: ENST00000431122
  CDS Start-End: 475-562
actgttcaaatgcagaggaaggcgaatgactcgagtctatggttttggtatactgagcctggggctactggtgtcagcctggtggtagtgcagctcatctgatgcctggggctgcaggatcctagttggttcctgtgacagaccttgggaagctcaatctcagatgtgttttcttaattgaagaaaatcatatcacatgtgaactttctgaccatactgtggagcggtgctaataaggagggttctgtgttcacttgactaccagaaacatttctagtttaccatcagagttttagccgcttccatgcttctgtgactgcagctactctcaggaagctgcactgttgcagaggtccattaactctttcaggacggtgtggaatcagtggggaaatctctaattgctactgacacagagcttttaggggcctggcctttgcagttccagatctactacagcaaacatcgttcaagatgtcccaccaagaaggcagcacagacggcttaccagacttagggactgaaagcctgttcagcagcccagaggagcagtctggagccg

SEQ ID NO: 125128 - DNA, 2013 bp, Homo sapiens
  Payload ID: 4564
  Gene Symbol: DCAF8L2
  Gene Name: DDB1 and CUL4 associated factor 8-like 2
  Uniprot ID: P0C7V8
  ENST ID: ENST00000545306
  CDS Start-End: 88-1983
tcctaaccgcaggccaactttcttcccagagcttttaggggcctggcctttgcagttccagatctactacagcaaacatcgttcaagatgtcccaccaagaaggcagcacagacggcttaccagacttagggactgaaagcctgttcagcagcccagaggagcagtctggagccgtggcggcgacagaggcctcctcagacattgacatagcgacctcagagctgagtgtgacagtgaccggagatggcagtgatagcagggatggtggattccccaacgatgccagcacagaaaatcgaagctcagaccaagaaagcgcaagtgaagacatcgaacttgagagcttggaggactttgagcatttcctcatgagtggtgaaagtttattccattaccctttagtgggagaggaggagacagaaagggaggaggaagacgaagagatacaagaggagggaggggaggaggaggaagaggaggaggaggaggaggaggaggaggaggaggaggaggaggaggaagaagaacagcctcgggcgggtccacaaggcagtggcggcaaccatgagcagtattcgttagaggaggatcaggcgctggaggagtgggtttcctcagagacatctgccctgccccgacctcgctggcaggtcgttactgctcttcaccagcggcagctgggttcacgtccccgctttgtatatgaggcctgtggggcaagagcctttgtgcagcgtttccgcctgcaatatcgtcttgcagaccatgtcggctgtgtcaatactgtacactttaaccagcgtggcacccggctggccagtagcggtgatgacctaaaggtgatagtgtgggactgggtgcggcagaggccagtactgaactttgaaagtggtcacacaaataatgtcttccaggccaagttccttcctaactgtggtgattccactctggccatgtgtgcccgtgatgggcaggtacgggtagcagagttaattaatgcatcatatttcaacaatactaagtgtgtggcccagcacaggggacctgcccacaagttggctctggagcctgactctccttataagttcctcacttcaggtgaagatgctgttgtcttcaccattgacctcagacaagaccggccagcttcaaaagttgtggtaacaagagaaaatgataagaaagtgggactgtatacaattactgtgaatcccgccaatacctaccaatttgcagtgggtggacaagatcagtttgtaaggatttatgaccagaggaaaattgataagaaagaaaacaatggcgtgctcaagaaattcactcctcatcatctggttaattgtgatttcccaacaaacatcacctgcgttgtgtacagccacgatggcacagagctgctagccagctacaatgatgacgatatttacctcttcaactcctctcacagtgatggtgctcaatacagtaagagatttaagggacacagaaataataccacagtcaaaggtgttaatttctatggccccaggagtgagtttgtagtgagcggtagtgattgcgggcacatcttcttctgggagaaatcatcctgccaaatcatccagttcctaaaggggagcagagaaggtacaataaactgtcttgaaccccacccttacctacctgtgttggcgtgcagtggcctagatcatgatgtcaagatctggacacccacagctaaagctgccactgagcttactgggttaaagaaggtgattaagaagaacaagtgggaacgagatgaagacagcttgcaccatggcagcctgtttgaccagtacatgctttggttcctcctgcgtcacgtgacgcagagaggtcgtcaccaggactggagaagtggtgaagctgaatttccagatgaagaatcggatgagtcttccagcacttcagagacatctgaggaggaggtccaagaccgagtgcagtgcatgccatcctgaaggcctcatatccagtccagctacatgcca

SEQ ID NO: 125129 - DNA, 5503 bp, Homo sapiens
  Payload ID: 4565
  Gene Symbol: DDHD1
  Gene Name: DDHD domain containing 1
  Uniprot ID: Q8NEL9
  ENST ID: ENST00000323669
  CDS Start-End: 1-2703
atgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcatatttcagacttcaagaatcgttctttaatctcccacaacttctttttccggaaaatgtaatgcagaataaagataatgccctcgtggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctct

SEQ ID NO: 125130 - DNA, 5603 bp, Homo sapiens
  Payload ID: 4565
  Gene Symbol: DDHD1
  Gene Name: DDHD domain containing 1
  Uniprot ID: Q8NEL9
  ENST ID: ENST00000357758
  CDS Start-End: 185-2803
aacgcagctgcggcggctgcgggtctcgtgggggcggagcggtcgccgctgccgccgcagctcgggtcgggatttgaaagattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctct

SEQ ID NO: 125131 - DNA, 12769 bp, Homo sapiens
  Payload ID: 4565
  Gene Symbol: DDHD1
  Gene Name: DDHD domain containing 1
  Uniprot ID: Q8NEL9
  ENST ID: ENST00000395606
  CDS Start-End: 107-2746
agattagaaacttcgggtggagagggcggcggcgttgaatgtgtggcggaagcgctgggggtcacggctccgcgcgccgccggacagccggcggcgtctccacagcatgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcggcgcgacaggagggtcccccggggaaaggaaacgtacccggcttggcggcccggcggcccggcaccgctatgaggtagtgacggagctgggcccggaggaggtacgctggttctacaaggaggacaagaagacctggaagcccttcatcggctacgactcgctccgcatcgagctcgccttccggaccctgctgcagaccacgggtgcccggccccagggcggggaccgggacggcgaccatgtgtgctcccccacgggcccagcctccagttccggagaagatgacgatgaggaccgcgcctgcggcttctgccagagtacgacggggcacgagccggagatggtggagcttgtgaacatcgagcctgtgtgcgtgcggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatggcagtgggatcaactattctgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcattggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctctattttgtgtacatgctatgatgattctcccaagtactgattagatcactgaactttagttagcttcccaagaattattaaccgttagaataagacttagattaaatcttgctttatttttactttaaaattagtcttgctaaggccttatgttagttcatactttcttttcaacagtaatcttgtttataatccagtgtttctgtgttttaggacataatttaaaaatatactggattttggccaggtgtggcagctcatgcctgtaatcccagcactttgggaggccaagcagggaagattacttgagcccaagagttgaaaaccaacctggacaacatggtgaaacccagactctacaaaaaatgcaaagattagctgggtgtgttggcagacgcctgtggtcccagctactcaggaggctgaggtcggtaggactgcatgattccgggaggtcaaggcttcagtgagccaagattgcaccactgcactccaccttgggtgacagagctggacactgtatccaaaaaaaaaaagtatgtatttacacacacacacacacacacacacacacactggatgttctaataactgctcttttgtatgtgaagcaagccttaggaatcttacgttttacttctttctgttaaacggcatctgttatcttttgaagtactcacactgaacatgcttcatgctgaatactcacgctaaaggcctcagacatgtaaacattcatccttagtctcttttttctctgttttctcattgggagctgaagcatcctagtctgcagaaaatttaacacaccatattccagctttgcatcacctagacagtagacaaaaggaaaagaaattgtcagtaccgtatcacagctagtgcctctgttcattccagtgatagtacatgagccccttccagtggagtcagatcaagccaaaagattttcctgtaaagtctgtagtagaagacaaatttctttttgatccattagattggtatttctatcttctcagctaattaatgagtaaggcatgtggacaatcgagaaaactaatttgagtgtatgtattaaaattgctcttctaaaaacacgtaaaatattaaagatcaaggcagagcaaaaaagaacgtagcaatcatatactagaaaaagaaactaagttttgctaaactatgtttgggttagttgacctctgtagctattctaaagttttctatcccttatctgtattccgctgtcattcctgtgcctcaagcctctgccaggaatctgatggtactctggctgaacttaaaacataagaatctcaaaggtctcatttagtaaatgttagtgctaagttggtgacagcctgggttatatgctttctctttcagtcttcagtagatgcttgtgatagttttcaaagaactgtaaaatttccgggtctgtacagatttttagagatcatttaatccaaccctgttacagtatcatgtcagcatttaaatagcagtaaaggtcatgaaaagtgaagtgaaaggcagcaaactccatgaaaaactaaatacagtgacaactgagggaagtggtaaagtaaaaaaatattaatgatggaattttaaagctggaaggggcatagagaccattcttttctcaataatattctgcaaatattaacaggtgtcatgtcagaaactaagtttaggaattgacaaattcaaaaatctcccttacagcagggctttgagagcctttgctacactaaatgctctgtgaatctatctggtgctgcgtgggggcctccaaatttatttaaccatattttttaatttggcatttacctagagaaatgctatcacatttaattccttcgttttacagtttcacctcctcatgtgattccttcattttgtaagtgaccgattccaccctatacaatcacatggccaatgaatgacagtcagaattagaacctagtcccctgattcccaaccatgtcttataccagactgtttcccctaatcgataggaaactactcctaaagggcagaaactgcctctctttgtttttgtcccccaacctcccctccacacatacacctctgtaatctgatgctttaagctcagattaaagcatcagcaagctttaatctgacacatggccgtaggcttgagttagcagttggtcccttctttcttccagactctcataagagtaccctatcaggtctggacagacttccgtttatgcctcagattcaaaatacccaggaaaaagaagaagaaatacaaaacaacaaaaagaaaatcaagaaaaaaataagatatccaggaaatattttgttagttttctattctggtgacaaatgcaaacttaaggaaacaagttgcacagtgttaactaatgtttaacattcctttccatagtgtttatgtgggccttttatcaattcatgacaaataggtcacctccaaaactgttccaacataggttaactcagaaatttaaaatttaagtactatcctttttggagactatgagaagagtttttactattgtgttttgttttgttttttggtgtgtgtgtgtatgtatgtgcattccccaaaaatagtccattggcagattgttagggtgaacttttcctctgcctttgtgtttgtataagggcgggtgcatgcttagtattgtctgctaccttatggtttttcatttatatgtaacatggtacaacttgcttcctccccacccaacagttgtcaggatatgttggggaatattctttaggaagattacatctggtcttctgttggagtaagatgaaaaacaagtatgttaacacttgacctttactgctttctcctggaagacattgaatatctaggagcgtcactcataccttcccttgactgtacccacacccactgcggtccctgcttgatctctcaaactttttgtttccctttgagcttcatgacaaaaaattataaccattttctggttctaaggctgccataatcccaactttgccagtaagaagatggagaatttttgctcatagggacatttctcagaagcagctggcaccataactctcctgagacccttgtttcctttctttcagctcctatgacttcttatgttcactctctctaacactactaaatgttgtcaatgactgcaatcacaactctttgaaggcaggctttttcttttcctttgttacctcttattttcaatagccaaagcaggttagttttctcagaatcttcagttttactgaagcatgcattatttctgttttctctctgcagtgatcagtttggatgacagaaactttaaacttttattctggcattgtccagttctgattttctcagctggaactggtgcatgcacatttaataatttcaaagaagtgagaggtaaatgttttctcctgcattatactgtgtttctctagctgaattgatccgtttgttatcttgctcacccgaaacaagtagttgtgccctacagtgagcaacctcagactaggctgttctaagcattctggagaaaataatcctcatcatacagtttgtggtaactcttccaaaaagtttatgaaaattgaaagatctccctatgcatcagctgtggctgccacattccgttctactaggaaggctagtggccacaactccctctagaacatcagaggataaagtacacttatatattagaaaagacaggcatattctgattatggttcattcacaatttctcagtccagggttcagtcagtgaccatagctctgaggtcttcaggctaactccaagaacccgtgccagatagaaacctactcctactacctttccactcaccttcccattcccccacctttgctaccaaagtgactttaaaagtcgagttttaggtgtttgtttttttaacagtctaggaatttcagtgcaattccgtgaggtggtgctgaccttagatgagaaatacgtggccaggctataaggactacatgtagaattgagatgggacagtgtacgtatggactgtgaggggaaagaaaaggtaaatgtgtgaaaggaaagagattggtgcatggtcatgacagtctgacagcttagacatttcagaggcattgtttatgagaaaggggatagggacacataggtctgatgacaaccaaagccctttgatgatgccatctgtcactcaaggctccccacagcctgcccaacctgactctcctgcctgcttctccactgcctaccttcaacaatcaaactatatttttgttacagcaaactacattccatttgcctttaaatgcttgcattttagttattgtactggctacctgtttttgtctgcccagcatcctgtttcccctccttttggatcctctcctagccaattccatgtcttgaatcctttcctgctccttgttaaaattattttctgctttgtgtgagtccctgtaagcaccagcagctcaatcagcactgtctgtaccatggtcaagagatgagtacatgactcaggtcagaccttatttcccaccccataagccacaatgattagacaagaaataggcacagaaccctaactagatagggcagaagccttccataggattttatttgctggccctgaaatgcaggtagccttctatggctgttaaacacaatccagtggcacatggggtgatatgaggatggagccatccatggcaaaactccaccctttcctgtgacatggattatgtgcatctgccatgaaaaggaagcatacacaagaaatgagccaagagttcctggagaactgaagcaagtatcacctccagatcagttgtacttttatttgcttacactattctgaggtgggtctctgtctcttggatccaaaagagttcaaattaataatcatttgacaaaaaattacctccacattcctaatgaagttgtctttgaagataatgtcttgtgatcccctggttgaagttaattactgcttgtgagcccccattaacaacgtgttcctttccccattgcttgcttgtatcagctttgctgaagatctattggctgtaggtgtgcagctttatttctgtgttctctattgtgttccattggtctacgtgtctgttattgtaccagtgccgtgctgttttggttactgtggtcttatagtttgaagccacatctgtgtgatgctgctggctttgttctttctgctttgggttgctttggctattcaggctctttctttggttccatctgaattttagaatagttgttttctaattctgtgaaaatgttccaacctctgtgaaaaatgaggttggtagtttgataggacagcattgattctgtaaattgctttgggcagtatggccatttttaaactatattgattcttccaatccatgaacatggaatgtttttccattttttggtttcatccctgatttctttctgccatgttttgtagttctccttgtagagatctttcacctccttggttaggtgtatttttaagtatttcagtttttttatggctattgtaaatggtattgggttcttgatttgctctcagcttgaacgttattggtgtatagaaatgctcctaatttttgtgcattgattttgtatcctgaaacttgactaaagttgtttatcagtctaggagcttttggcagagtcttcggggttttctaggtataaaatcatatcagcgaagagagctagtttgatttcttttcccagttggatgccttttatttatttctcttgcctgattgctctaagttgaatgggagcgatgagactgggcatcctcttcttattccagttctcagaaggaatagttccagcttttgctcatccagtatgatgtctgtgggttggttgtagatggctcttattattttgagatatgttcctttgatacctagtctgttgaggggttttatcatgagggatgttggattttatccgtattcaataaatggtgttgggataactggctagccctatgcagaagaatgaaactggaccccccacctttcaccgtatatgaaaattaactcaagatggattaaagatttaaatgtaagacctcaaactgtaaaaatcctagaagaaaacctaggaaatacccttatcaacatcagccttggcaaagaacttttggctaagtccccaaaggcaattgcaacaaaacagaaattggcaagtggggacctaattaaagcactctgcacagcaaaagacactatcaacagagtaaacagacaacatacagaattggagaaaatatttgcaaactagacatccaacaaagatctgacatccagaatcaataaggaacttaacaagcaaaaaacaaccccattaaaaaatgggtgaaggacatgaacagacacttctcaaaagaagacatacaagcaatcaacaaacgtgaaaaaatgctcatcactaatcatcagagaaatgcaaatcaaaaccacaataagataccatctcacaccagttagaatggctattgtaaagaagtctaataacatgccagtaaggtttcagagaaaagagaacatttatacactgttgtgggaatgtaaattagttcagtcactgtggaaagcagtttggagatttctcaaataacttaaaacagatctaccattcaacccagcatatgggtttatttcccaaaaggaaataaatccttctaccaaaaacacatatggtcatcacagtgctattcacagtagcaaagacagatcaacgtggctgcccatcaacagtggactggataaagaaaatgtggtacatataaatcatggagtattaggcagccataaaaagaacaaaatcatgtcctttgcagccagccacatggatacagctggaagccataatctaagcaaattaagaacagaaaaccaagtactgcatgttctaacaaatgggagctaaatattgagtacctcaggatgcaaaggtgggaacaacagacactgcagactggaacactgtgggtgaggagggcagaaggataggttgaaaaactacctattgggtactatgctcactacctgggtgatgggatctgtacctcaaacctcagcatcacacaatatacccttgtaacaaacttgcacatttacccactgtttctaaatgaaaagttgaaatattttttattaaaaaacacaaaagcaatatgtttctc

SEQ ID NO: 125132 - DNA, 599 bp, Homo sapiens
  Payload ID: 4565
  Gene Symbol: DDHD1
  Gene Name: DDHD domain containing 1
  ENST ID: ENST00000556910
  CDS Start-End: 323-599
aagtatgtgagggatggtgtttggtcagggacaggatggagattgtgaagggagcacctgcacatgaatggcgcatttgggacaatagctggaaaagagacagggtagatatgcagtgctaaggagtttggcctttatcctgcgagtaatgaggaaccaaacagtagaaggttctttatacttacatgtgattaatgacaatgcaaaagttgagctggagagttggaagcagaatatcagtagaatgctagtgtcataaatcaggtgaaaactggtgggagcctacagaagttaacctaaagaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggatttt

SEQ ID NO: 125133 - DNA, 12339 bp, Homo sapiens
  Payload ID: 4565
  Gene Symbol: DDHD1
  Gene Name: DDHD domain containing 1
  ENST ID: ENST00000612692
  CDS Start-End: 1-2316
atgaattacccgggccgcgggtccccacggagccccgagcataacggccgaggcggcggcggcggcgcctgggagctgggctcagacgcgaggccagcgttcggcggcggcgtctgctgcttcgagcacctgcccggcggggacccggacgacggcgacgtgcccctggccctgctgcgcggggaacccgggctgcatttggcgccgggcaccgacgaccacaaccaccacctcgcgctggacccctgcctcagtgacgagaactatgacttcagctccgccgagtcgggctcctcgctgcgctactacagcgagggtgagagcggcggcggcggcagctccttgtcgctgcacccgccgcagcagcctccgctggtcccgacgaactcggggggcggcctctacgaggtggatgtgacccaaggagagtgctacccggtgtactggaaccaggctgataaaataccagtaatgcgtggacagtggtttattgacggcacttggcagcctctagaagaggaagaaagtaatttaattgagcaagaacatctcaattgttttaggggccagcagatgcaggaaaatttcgatattgaagtgtcaaaatccatagatggaaaagatgctgttcatagtttcaagttgagtcgaaaccatgtggactggcacagtgtggatgaagtatatctttatagtgatgcaacaacatctaaaattgcaagaacagttacccaaaaactgggattttctaaagcatcaagtagtggtaccagacttcatagaggttatgtagaagaagccacattagaagacaagccatcacagactacccatattgtatttgttgtgcatggcattgggcagaaaatggaccaaggaagaattatcaaaaatacagctatgatgagagaagctgcaagaaaaatagaagaaaggcatttttccaaccatgcaacacatgttgaatttctgcctgttgagtggcggtcaaaacttactcttgatggagacactgttgattccattactcctgacaaagtacgaggtttaagggatatgctgaacagcagtgcaatggacataatgtattatactagtccactttatagagatgaactagttaaaggccttcagcaagagctgaatcgattgtattcccttttctgttctcggaatccagactttgaagaaaaagggggtaaagtctcaatagtatcacattccttgggatgtgtaattacttatgacataatgactggctggaatccagttcggctgtatgaacagttgctgcaaaaggaagaagagttgcctgatgaacgatggatgagctatgaagaacgacatcttcttgatgaactctatataactaaacgacggctgaaggaaatagaagaacggcttcacggattgaaagcatcatctatgacacaaacacctgccttaaaatttaaggttgagaatttcttctgtatgggatccccattagcagttttcttggcgttgcgtggcatccgcccaggaaatactggaagtcaagaccatattttgcctagagagatttgtaaccggttactaaatatttttcatcctacagatccagtggcttatagattagaaccattaatactgaaacactacagcaacatttcacctgtccagatccactggtacaatacttcaaatcctttaccttatgaacatatgaagccaagctttctcaacccagctaaagaacctacctcagtttcagagaatgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagtcatctgaaacatcaaaagactcaatggaagatgagaagaagccagttgcctcaccttctgctaccaccgtagggacacagacccttccacatagcagttctggcttcctcgattctgcatatttcagacttcaagaatcgttctttaatctcccacaacttctttttccggaaaatgtaatgcagaataaagataatgccctcgtggagttggatcacaggattgattttgaactcagagaaggccttgtggagagccgctattggtcagctgtcacgtcgcatactgcctattggtcatccttggatgttgccctttttcttttaaccttcatgtataaacatgagcacgatgatgatgcaaaacccaatttagatccaatctgaactctcttgaaggacatgaatggcctaaaactgattttttttttttccgttaaaatgtgtgtgtcaagatacggagatttcagggttaaagtatatttcagttttctttagggcaacatatatttgaatttaaaagcactttatttaaaaaaaaaagaagttttcagttctgaagaagtcatttacagtttgcatcattttaattatgagtctgacaaaaccttctccagagaatcaagcaagacctggatgtgaagaaggtttgggtaaactgcatgtaaaggctacaaatcacaatctgattcctcccaaatataaaggcatatggaacataatgtattaaccaaagtatgttataaatcaaaaatggtcaaggttcagcatattctatatgaagatcacaaggtggtatcgttttagatttctatgaaggctttcatttgtacatccctttgaaaaaatataacagatttaaaatgttttgaatttaacttgtttagaaaaactaatgcttaaaacaatatttgaactactgtatttataatttattacctctaattgctttatttcagtgtatgagacattactgttttaatgtttgctttgaacataatttaagaaccagatttattttctatagtgataaacccttttttctcagaactccatctttgtactcttcagatgaatatatagacactgtggcatacattttttttcattaaaaacttatggcttcatacaacactagttcaattttttaaataaactttttattatgttacatgtacttcagagaaagctaaagtttctctaaacttgacacggagtactccataatgggtacatttcattagctttattagaaaactagtaaatgcttttgaataggtagtatgacagctattttaaatgtataaacatttgtgtgccaaacaacatatatgaagggatgtgatgccactaactagtgcacattgtttctcaatgtgccattgagacacaaggcacagtaagtcaggattctgaggcattggaagggttttcttcagctgtaattgtttccacagtgcttttcatctgaggggctcaaagtttaagagtgcattcaataacccatgtactagcttcttgaggtaagtaaataaatcttgttctcatgttacatgttaatacaccaaggcaccaaaacatttaaagtgccatgaattagattacatcagaaatcagaaaagcttggattgagctagtcaccgtggttcacgcctgtaatcccaacacttcgggaggccaagatgggaggatctcttgagcccaggatttcaagaccagcttgggcaacatagtgagaccctcttctctgcaaaaactgacaaaaattagccacttgtagtggtgtacacctgtagtcccagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccaggccatattcttttatatgctgttcaatgacttgattcacatgtgaccttttagtagtttgcaaacaataataacagaagttgcaattcataattcagagaaatgaccatgaagccggtgtttccctgcttgatttctatgttcttggattctcacacaaaagaggagttacctagaggggatcagtagccatccctgttgcacacaaccctcacttctgagtggtttccactaggttccacttaaggtgctgtcttttcttaacttgcaaggaattgcttagcttcccaataatcattgtcaaactgggagcaaagttggtcagctgtatctctcacctcctcctttcttcataagatagtagaatctgtggcttacttgtaggttttacttagtgcttcagtactgttggctgttttggccttttgctgaatttgcacaacaacataaagcacttctttttaatgtttaaaaaaaattccaaggctccatgaccaagtatgtgactcactaagaaacccttgctataaaaggcttttgatgaaatcttagcaaagctaaattatctctaacttagagattcctatgaactcaggtcattttcatagcctgtttattttgtaggtctaatttagttctcaggaaaattaaactcatgctatatgactgtatcgttaaaggtacttgagcgtatgttgctgtaggtggtatgacactcaaatgcataagaacttgaagggatttattcttaaccactagaatatgaagagccctttttacctgagaagagtgaaattatgtcagaccttttaatttgatatcactgagtaaaaggtatgttcctatagccataggaatatgtctgcttcctttttttcatgttgagaaaacagtcaaatttaaccatttggagtttatttgaattcttggaaagagcaatattcaaaaccttttcaaaaataagatattctggactactggatggatgttttgttttcagttcatttttcatcagtagagatggtgatttcggttttgtagtatccttgtttctatgtctgtgcatgttaacattggatgtatttgtatatacttaattaatatacagactgtgtgtcattctggcttgattagaagctaagtcagttactgagtaacattttgcaactttattccagcaagtactaaatcggccaaaaaaagttttgtttttgataccattaaaattttattctctattttgtgtacatgctatgatgattctcccaagtactgattagatcactgaactttagttagcttcccaagaattattaaccgttagaataagacttagattaaatcttgctttatttttactttaaaattagtcttgctaaggccttatgttagttcatactttcttttcaacagtaatcttgtttataatccagtgtttctgtgttttaggacataatttaaaaatatactggattttggccaggtgtggcagctcatgcctgtaatcccagcactttgggaggccaagcagggaagattacttgagcccaagagttgaaaaccaacctggacaacatggtgaaacccagactctacaaaaaatgcaaagattagctgggtgtgttggcagacgcctgtggtcccagctactcaggaggctgaggtcggtaggactgcatgattccgggaggtcaaggcttcagtgagccaagattgcaccactgcactccaccttgggtgacagagctggacactgtatccaaaaaaaaaaagtatgtatttacacacacacacacacacacacacacacactggatgttctaataactgctcttttgtatgtgaagcaagccttaggaatcttacgttttacttctttctgttaaacggcatctgttatcttttgaagtactcacactgaacatgcttcatgctgaatactcacgctaaaggcctcagacatgtaaacattcatccttagtctcttttttctctgttttctcattgggagctgaagcatcctagtctgcagaaaatttaacacaccatattccagctttgcatcacctagacagtagacaaaaggaaaagaaattgtcagtaccgtatcacagctagtgcctctgttcattccagtgatagtacatgagccccttccagtggagtcagatcaagccaaaagattttcctgtaaagtctgtagtagaagacaaatttctttttgatccattagattggtatttctatcttctcagctaattaatgagtaaggcatgtggacaatcgagaaaactaatttgagtgtatgtattaaaattgctcttctaaaaacacgtaaaatattaaagatcaaggcagagcaaaaaagaacgtagcaatcatatactagaaaaagaaactaagttttgctaaactatgtttgggttagttgacctctgtagctattctaaagttttctatcccttatctgtattccgctgtcattcctgtgcctcaagcctctgccaggaatctgatggtactctggctgaacttaaaacataagaatctcaaaggtctcatttagtaaatgttagtgctaagttggtgacagcctgggttatatgctttctctttcagtcttcagtagatgcttgtgatagttttcaaagaactgtaaaatttccgggtctgtacagatttttagagatcatttaatccaaccctgttacagtatcatgtcagcatttaaatagcagtaaaggtcatgaaaagtgaagtgaaaggcagcaaactccatgaaaaactaaatacagtgacaactgagggaagtggtaaagtaaaaaaatattaatgatggaattttaaagctggaaggggcatagagaccattcttttctcaataatattctgcaaatattaacaggtgtcatgtcagaaactaagtttaggaattgacaaattcaaaaatctcccttacagcagggctttgagagcctttgctacactaaatgctctgtgaatctatctggtgctgcgtgggggcctccaaatttatttaaccatattttttaatttggcatttacctagagaaatgctatcacatttaattccttcgttttacagtttcacctcctcatgtgattccttcattttgtaagtgaccgattccaccctatacaatcacatggccaatgaatgacagtcagaattagaacctagtcccctgattcccaaccatgtcttataccagactgtttcccctaatcgataggaaactactcctaaagggcagaaactgcctctctttgtttttgtcccccaacctcccctccacacatacacctctgtaatctgatgctttaagctcagattaaagcatcagcaagctttaatctgacacatggccgtaggcttgagttagcagttggtcccttctttcttccagactctcataagagtaccctatcaggtctggacagacttccgtttatgcctcagattcaaaatacccaggaaaaagaagaagaaatacaaaacaacaaaaagaaaatcaagaaaaaaataagatatccaggaaatattttgttagttttctattctggtgacaaatgcaaacttaaggaaacaagttgcacagtgttaactaatgtttaacattcctttccatagtgtttatgtgggccttttatcaattcatgacaaataggtcacctccaaaactgttccaacataggttaactcagaaatttaaaatttaagtactatcctttttggagactatgagaagagtttttactattgtgttttgttttgttttttggtgtgtgtgtgtatgtatgtgcattccccaaaaatagtccattggcagattgttagggtgaacttttcctctgcctttgtgtttgtataagggcgggtgcatgcttagtattgtctgctaccttatggtttttcatttatatgtaacatggtacaacttgcttcctccccacccaacagttgtcaggatatgttggggaatattctttaggaagattacatctggtcttctgttggagtaagatgaaaaacaagtatgttaacacttgacctttactgctttctcctggaagacattgaatatctaggagcgtcactcataccttcccttgactgtacccacacccactgcggtccctgcttgatctctcaaactttttgtttccctttgagcttcatgacaaaaaattataaccattttctggttctaaggctgccataatcccaactttgccagtaagaagatggagaatttttgctcatagggacatttctcagaagcagctggcaccataactctcctgagacccttgtttcctttctttcagctcctatgacttcttatgttcactctctctaacactactaaatgttgtcaatgactgcaatcacaactctttgaaggcaggctttttcttttcctttgttacctcttattttcaatagccaaagcaggttagttttctcagaatcttcagttttactgaagcatgcattatttctgttttctctctgcagtgatcagtttggatgacagaaactttaaacttttattctggcattgtccagttctgattttctcagctggaactggtgcatgcacatttaataatttcaaagaagtgagaggtaaatgttttctcctgcattatactgtgtttctctagctgaattgatccgtttgttatcttgctcacccgaaacaagtagttgtgccctacagtgagcaacctcagactaggctgttctaagcattctggagaaaataatcctcatcatacagtttgtggtaactcttccaaaaagtttatgaaaattgaaagatctccctatgcatcagctgtggctgccacattccgttctactaggaaggctagtggccacaactccctctagaacatcagaggataaagtacacttatatattagaaaagacaggcatattctgattatggttcattcacaatttctcagtccagggttcagtcagtgaccatagctctgaggtcttcaggctaactccaagaacccgtgccagatagaaacctactcctactacctttccactcaccttcccattcccccacctttgctaccaaagtgactttaaaagtcgagttttaggtgtttgtttttttaacagtctaggaatttcagtgcaattccgtgaggtggtgctgaccttagatgagaaatacgtggccaggctataaggactacatgtagaattgagatgggacagtgtacgtatggactgtgaggggaaagaaaaggtaaatgtgtgaaaggaaagagattggtgcatggtcatgacagtctgacagcttagacatttcagaggcattgtttatgagaaaggggatagggacacataggtctgatgacaaccaaagccctttgatgatgccatctgtcactcaaggctccccacagcctgcccaacctgactctcctgcctgcttctccactgcctaccttcaacaatcaaactatatttttgttacagcaaactacattccatttgcctttaaatgcttgcattttagttattgtactggctacctgtttttgtctgcccagcatcctgtttcccctccttttggatcctctcctagccaattccatgtcttgaatcctttcctgctccttgttaaaattattttctgctttgtgtgagtccctgtaagcaccagcagctcaatcagcactgtctgtaccatggtcaagagatgagtacatgactcaggtcagaccttatttcccaccccataagccacaatgattagacaagaaataggcacagaaccctaactagatagggcagaagccttccataggattttatttgctggccctgaaatgcaggtagccttctatggctgttaaacacaatccagtggcacatggggtgatatgaggatggagccatccatggcaaaactccaccctttcctgtgacatggattatgtgcatctgccatgaaaaggaagcatacacaagaaatgagccaagagttcctggagaactgaagcaagtatcacctccagatcagttgtacttttatttgcttacactattctgaggtgggtctctgtctcttggatccaaaagagttcaaattaataatcatttgacaaaaaattacctccacattcctaatgaagttgtctttgaagataatgtcttgtgatcccctggttgaagttaattactgcttgtgagcccccattaacaacgtgttcctttccccattgcttgcttgtatcagctttgctgaagatctattggctgtaggtgtgcagctttatttctgtgttctctattgtgttccattggtctacgtgtctgttattgtaccagtgccgtgctgttttggttactgtggtcttatagtttgaagccacatctgtgtgatgctgctggctttgttctttctgctttgggttgctttggctattcaggctctttctttggttccatctgaattttagaatagttgttttctaattctgtgaaaatgttccaacctctgtgaaaaatgaggttggtagtttgataggacagcattgattctgtaaattgctttgggcagtatggccatttttaaactatattgattcttccaatccatgaacatggaatgtttttccattttttggtttcatccctgatttctttctgccatgttttgtagttctccttgtagagatctttcacctccttggttaggtgtatttttaagtatttcagtttttttatggctattgtaaatggtattgggttcttgatttgctctcagcttgaacgttattggtgtatagaaatgctcctaatttttgtgcattgattttgtatcctgaaacttgactaaagttgtttatcagtctaggagcttttggcagagtcttcggggttttctaggtataaaatcatatcagcgaagagagctagtttgatttcttttcccagttggatgccttttatttatttctcttgcctgattgctctaagttgaatgggagcgatgagactgggcatcctcttcttattccagttctcagaaggaatagttccagcttttgctcatccagtatgatgtctgtgggttggttgtagatggctcttattattttgagatatgttcctttgatacctagtctgttgaggggttttatcatgagggatgttggattttatccgtattcaataaatggtgttgggataactggctagccctatgcagaagaatgaaactggaccccccacctttcaccgtatatgaaaattaactcaagatggattaaagatttaaatgtaagacctcaaactgtaaaaatcctagaagaaaacctaggaaatacccttatcaacatcagccttggcaaagaacttttggctaagtccccaaaggcaattgcaacaaaacagaaattggcaagtggggacctaattaaagcactctgcacagcaaaagacactatcaacagagtaaacagacaacatacagaattggagaaaatatttgcaaactagacatccaacaaagatctgacatccagaatcaataaggaacttaacaagcaaaaaacaaccccattaaaaaatgggtgaaggacatgaacagacacttctcaaaagaagacatacaagcaatcaacaaacgtgaaaaaatgctcatcactaatcatcagagaaatgcaaatcaaaaccacaataagataccatctcacaccagttagaatggctattgtaaagaagtctaataacatgccagtaaggtttcagagaaaagagaacatttatacactgttgtgggaatgtaaattagttcagtcactgtggaaagcagtttggagatttctcaaataacttaaaacagatctaccattcaacccagcatatgggtttatttcccaaaaggaaataaatccttctaccaaaaacacatatggtcatcacagtgctattcacagtagcaaagacagatcaacgtggctgcccatcaacagtggactggataaagaaaatgtggtacatataaatcatggagtattaggcagccataaaaagaacaaaatcatgtcctttgcagccagccacatggatacagctggaagccataatctaagcaaattaagaacagaaaaccaagtactgcatgttctaacaaatgggagctaaatattgagtacctcaggatgcaaaggtgggaacaacagacactgcagactggaacactgtgggtgaggagggcagaaggataggttgaaaaactacctattgggtactatgctcactacctgggtgatgggatctgtacctcaaacctcagcatcacacaatatacccttgtaacaaacttgcacatttacccactgtttctaaatgaaaagttgaaatattttttattaaaaaacacaaaagcaatatgtttctc

SEQ ID NO: 125134 - DNA, 4921 bp, Homo sapiens
  Payload ID: 4566
  Gene Symbol: DDHD2
  Gene Name: DDHD domain containing 2
  Uniprot ID: O94830
  ENST ID: ENST00000397166
  CDS Start-End: 526-2661
attccgactttcccgccccgtacgtgaggggccgccttgaagcctcttccgccacggacactcgaaactgatcttgaagcccctgccgtcacggatactagaaactgatctcgaagccccttccgccacggacactcgaaactctcccccactgttagacctcagcagccagcagcccgccgcccggcgctgcagctccctgcccgcaggagccacgtctcgcgcgactccccccacctctcgcgacacttgccgcccgtgccctgcggccctgcacgccccacccgcggtcgcgcgccgcgctccccgccgcctcaccttttcgcctggcatccgggcccgctactcgcccactgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccatattgactagtggcctacttttacctggactcacccgtctcaaagtcaagaaaatcagtacagtca

SEQ ID NO: 125135 - DNA, 4113 bp, Homo sapiens
  Payload ID: 4566
  Gene Symbol: DDHD2
  Gene Name: DDHD domain containing 2
  Uniprot ID: O94830
  ENST ID: ENST00000517385
  CDS Start-End: 928-1920
gcactctagcctgggtgacagagtgagactccgtctcaaaaatatgcactgctgatctgttaatagagttatggaatcattgagctaaatgaagtttgcatatgaacaaatgaatgaattggctacaaattgatatgatttatagaaactctgttcgaaagtattggggacttgatgtttaaacattattttagtaaaaattcctataaccatgtatcatctgtaggattgatttggtacctatttctcctgttggaccatgagttcctccagagcagagcttttgtcttagactattttatttctatttctatttcttttttttctttctttttttttttttttttgagacagtctcttgctctgtcacccaggctggaatgcagtggcatgatctcggctcactgcaacctctgcctgcagggttcaaatgattctcctgcttcagcctccccagtagctgggacaggcgcatgccaccgtacccggctaatttttgtatctttagtagagacagggtgttggtcagactggtcttgaactcctgaccttgtgatccgcccacctcggcctcccaaagtgctgggattacagatgtgagccaccatgcccagcctagactgttttatttcttaagcactgttttcctaatttcttaagcactgagctcccttaaaattcagcaaatgtttgttaatgatgatgaatattttactaatttctttaaaaacatattttcaattgaagttgcaaaaccttggaacctcttaatttatatcttgcataaatgacaatttgttaaagttaagatacattgctgtggaaatctatgtatttctttactgcaaaatagtattaaaggaaactaaatgaatttcaagaatatgagctttataatttaatttttaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaacc

SEQ ID NO: 125136 - DNA, 4532 bp, Homo sapiens
  Payload ID: 4566
  Gene Symbol: DDHD2
  Gene Name: DDHD domain containing 2
  Uniprot ID: O94830
  ENST ID: ENST00000520272
  CDS Start-End: 201-2336
ggaacctcggctcccgggaagccccgagcctgggggaaccctgggcaccctgtgaaccctgtggtctgcactggctgccctgctgctgtcgcggggctgcgggcggacgacctgagcccgagctccgagggcccggagcggggcgccagggcctagggtcgcgggggccaggggcgcgccagggtggctgagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaacatgaaaccata

SEQ ID NO: 125137 - DNA, 945 bp, Homo sapiens
  Payload ID: 4566
  Gene Symbol: DDHD2
  Gene Name: DDHD domain containing 2
  ENST ID: ENST00000529845
  CDS Start-End: 313-801
actatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcaccctgattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttg

SEQ ID NO: 125138 - DNA, 1124 bp, Homo sapiens
  Payload ID: 4566
  Gene Symbol: DDHD2
  Gene Name: DDHD domain containing 2
  ENST ID: ENST00000527415
  CDS Start-End: 87-515
catcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaaggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaaggattcgctaaatattgtaatggatcaaggagatacacctacactagaggaagatttgaagaaacttcagctctctgaattctttgatatctttgagaaggagaaagtagataaggaagctctgg

SEQ ID NO: 125139 - DNA, 568 bp, Homo sapiens
  Payload ID: 4566
  Gene Symbol: DDHD2
  Gene Name: DDHD domain containing 2
  ENST ID: ENST00000527834
  CDS Start-End: 100-568
ttcttgctgctgccatgtgaagaaggacgtatttgcttccccttctgccacgatgggaagttttccgaggcctccgccactatgctgaactagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctccca

SEQ ID NO: 125140 - DNA, 683 bp, Homo sapiens
  Payload ID: 4566
  Gene Symbol: DDHD2
  Gene Name: DDHD domain containing 2
  ENST ID: ENST00000533100
  CDS Start-End: 272-683
ctctcccccactgttagacctcagcagccagcagcccgccgcccggcgctgcagctccctgcccgcaggagccacgtctcgcgcgactccccccacctctcgcgacacttgccgcccgtgccctgcggccctgcacgccccacccgcggtcgcgcgccgcgctccccgccgcctcaccttttcgcctggcatccgggcccgctactcgcccactgggagcgccgtggcgcctggtgttcggcgcgagcccggcggggctgcagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagagg

SEQ ID NO: 125141 - DNA, 600 bp, Homo sapiens
  Payload ID: 4566
  Gene Symbol: DDHD2
  Gene Name: DDHD domain containing 2
  ENST ID: ENST00000528358
  CDS Start-End: 117-600
gccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttac

SEQ ID NO: 125142 - DNA, 696 bp, Homo sapiens
  Payload ID: 4566
  Gene Symbol: DDHD2
  Gene Name: DDHD domain containing 2
  ENST ID: ENST00000532222
  CDS Start-End: 30-696
gaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtgttaatgattttcgcagtgtttccttgaacttgctacagacacatt

SEQ ID NO: 125143 - DNA, 604 bp, Homo sapiens
  Payload ID: 4566
  Gene Symbol: DDHD2
  Gene Name: DDHD domain containing 2
  ENST ID: ENST00000528613
  CDS Start-End: 1-240
aacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatttgtgactgcagctcttctcccactttcttccctagacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaag

SEQ ID NO: 125144 - DNA, 358 bp, Homo sapiens
  Payload ID: 4566
  Gene Symbol: DDHD2
  Gene Name: DDHD domain containing 2
  ENST ID: ENST00000529642
  CDS Start-End: 188-358
ctcagggagggcaggagagcctgaggagtggcggggccgccagataatagattctaaggagacatggattcctttcaactctgaggattcacagcagctggaagaggcatatagctctggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggaaacttacatgcttgctgtaactttggatgaatggaaaaagaaactg

SEQ ID NO: 125145 - DNA, 697 bp, Homo sapiens
  Payload ID: 4566
  Gene Symbol: DDHD2
  Gene Name: DDHD domain containing 2
  ENST ID: ENST00000526237
  CDS Start-End: 174-425
actgggagcgccgtggcgcctggtgttcggcgcgagcccggcggggctgcaggttccgccctgctccgccgcgccccgcccgggctggggtaaaggccgcggccgggccatgcagtgtcctcctcagggagggcaggagagcctgaggagtggcggggccgccagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggaaacttacatgcttgctgtaactttggatgaatggaaaaagaaactggaatctcccaacagagaaattattattttacacaatccaaagcttatggtgcattaccagccagttgcagggtctgatgattggggttcaacacccacggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtggta

SEQ ID NO: 125146 - DNA, 774 bp, Homo sapiens
  Payload ID: 4566
  Gene Symbol: DDHD2
  Gene Name: DDHD domain containing 2
  ENST ID: ENST00000526144
  CDS Start-End: 1-641
cagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatgtaagttttaaaatgtcatatatatagtgtaattcttacatattaacatgttataatgaactatggagcctcaagctctttttaaatatactagctgttgcctgtca

SEQ ID NO: 125147 - DNA, 548 bp, Homo sapiens
  Payload ID: 4566
  Gene Symbol: DDHD2
  Gene Name: DDHD domain containing 2
  ENST ID: ENST00000532106
  CDS Start-End: 1-548
gagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaagggtattaagagaccagccccgcagcctgcttcaggggcaaacatc

SEQ ID NO: 125148 - DNA, 671 bp, Homo sapiens
  Payload ID: 4567
  Gene Symbol: DDT
  Gene Name: D-dopachrome tautomerase
  Uniprot ID: P30046
  ENST ID: ENST00000350608
  CDS Start-End: 129-485
gatcccggtgccagggaccctgcccagttccaggcgtcgccctgacccagaaacgactgggcgccgccgtcctggaaaggccccagcgcacggacatctgaggagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaacatga

SEQ ID NO: 125149 - DNA, 713 bp, Homo sapiens
  Payload ID: 4567
  Gene Symbol: DDT
  Gene Name: D-dopachrome tautomerase
  Uniprot ID: P30046
  ENST ID: ENST00000398344
  CDS Start-End: 171-527
gtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaacatga

SEQ ID NO: 125150 - DNA, 569 bp, Homo sapiens
  Payload ID: 4567
  Gene Symbol: DDT
  Gene Name: D-dopachrome tautomerase
  ENST ID: ENST00000403754
  CDS Start-End: 46-546
cccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttggg

SEQ ID NO: 125151 - DNA, 805 bp, Homo sapiens
  Payload ID: 4567
  Gene Symbol: DDT
  Gene Name: D-dopachrome tautomerase
  ENST ID: ENST00000404092
  CDS Start-End: 234-632
atcccttcaaggccactcagtccacagcattctctggtggcagacgctgcaggaggagcccatcagtgctggctgctgagtctttgaaagcagacccacggtggcagcatggtgcccaacacgtggaggctgcagtgcgggaggacttcttccaggaggccctcccagctgtcctgaaggccaaggacctgcctccagtagaacctgctgttaaagagaatctgaagaccttaatgcagcttttcttgctagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcct

SEQ ID NO: 125152 - DNA, 573 bp, Homo sapiens
  Payload ID: 4567
  Gene Symbol: DDT
  Gene Name: D-dopachrome tautomerase
  Uniprot ID: P30046
  ENST ID: ENST00000430101
  CDS Start-End: 46-369
cccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccgccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttggg

SEQ ID NO: 125153 - DNA, 333 bp, Homo sapiens
  Payload ID: 4567
  Gene Symbol: DDT
  Gene Name: D-dopachrome tautomerase
  ENST ID: ENST00000428792
  CDS Start-End: 1-152
gaaaagacctccctcccccacaagaagcgtctgcaacccaaacctggcgttctgtgaccgagttaaagtttcctcttgggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcctcattcaaa

SEQ ID NO: 125154 - DNA, 671 bp, Homo sapiens; identical to SEQ ID NO: 125148
  Payload ID: 4567
  Gene Symbol: DDT
  Gene Name: D-dopachrome tautomerase
  Uniprot ID: P30046
  ENST ID: ENST00000615721
  CDS Start-End: 129-485

SEQ ID NO: 125155 - DNA, 569 bp, Homo sapiens; identical to SEQ ID NO: 125150
  Payload ID: 4567
  Gene Symbol: DDT
  Gene Name: D-dopachrome tautomerase
  ENST ID: ENST00000626838
  CDS Start-End: 46-546

SEQ ID NO: 125156 - DNA, 576 bp, Homo sapiens
  Payload ID: 4567
  Gene Symbol: DDT
  Gene Name: D-dopachrome tautomerase
  Uniprot ID: P30046
  ENST ID: ENST00000629401
  CDS Start-End: 20-343
ttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccgccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgt

SEQ ID NO: 125157 - DNA, 333 bp, Homo sapiens; identical to SEQ ID NO: 125153
  Payload ID: 4567
  Gene Symbol: DDT
  Gene Name: D-dopachrome tautomerase
  ENST ID: ENST00000629936
  CDS Start-End: 1-152

SEQ ID NO: 125158 - DNA, 713 bp, Homo sapiens; identical to SEQ ID NO: 125149
  Payload ID: 4567
  Gene Symbol: DDT
  Gene Name: D-dopachrome tautomerase
  Uniprot ID: P30046
  ENST ID: ENST00000626871
  CDS Start-End: 171-527

SEQ ID NO: 125159 - DNA, 805 bp, Homo sapiens
  Payload ID: 4567
  Gene Symbol: DDT
  Gene Name: D-dopachrome tautomerase
  ENST ID: ENST00000626046
  CDS Start-End: 234-632
atcccttcaaggccactcagtccacagcattctctggtggcagacgctgcaggaggagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctagctgtttccgttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggatacttatccgctttttccccttggagtcctggcagattggcaagatagggacggtcatgacttttttatgattgggcacggagggatccagggcatctgtgaactggctgcttcttccagagagatctcttggcagagtgagggcctggagataaccagctttggattatcccgcatgcaacattcctgtgatcacataatcctcttcttcatcctcatatgaaataaatgaagagagcttcct

SEQ ID NO: 125160 - DNA, 1545 bp, Homo sapiens
  Payload ID: 4568
  Gene Symbol: DDTL
  Gene Name: D-dopachrome tautomerase-like
  Uniprot ID: A6NHG4
  ENST ID: ENST00000215770
  CDS Start-End: 15-419
ttcctctgcccgccatgccgttcctggagctggacacgaatttgcccgccaaccgagtgcccgcggggctggagaaacgactctgcgccgccgctgcctccatcctgggcaaacctgcggaccgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaag

SEQ ID NO: 125161 - DNA, 1545 bp, Homo sapiens; identical to SEQ ID NO: 125160
  Payload ID: 4568
  Gene Symbol: DDTL
  Gene Name: D-dopachrome tautomerase-like
  Uniprot ID: A6NHG4
  ENST ID: ENST00000621454
  CDS Start-End: 15-419

SEQ ID NO: 125162 - DNA, 1306 bp, Homo sapiens
  Payload ID: 4569
  Gene Symbol: DDRGK1
  Gene Name: DDRGK domain containing 1
  Uniprot ID: Q96HY6
  ENST ID: ENST00000354488
  CDS Start-End: 59-1003
ggcctatgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggacaccataaatcgcatccaggacctgctggctgaggggactataacaggtgtgattgacgaccggggcaagttcatctacataaccccagaggaactggccgccgtggccaacttcatccgacagcggggccgggtgtccatcgccgagcttgcccaagccagcaactccctcatcgcctggggccgggagtcccctgcccaagccccagcctgaccccagtccttccctcttggactcagagttggtgtggcctacctggctatacatcttcatccctccccaccatcctggggaagtgatggtgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcacattta

SEQ ID NO: 125163 - DNA, 1128 bp, Homo sapiens
  Payload ID: 4569
  Gene Symbol: DDRGK1
  Gene Name: DDRGK domain containing 1
  ENST ID: ENST00000380201
  CDS Start-End: 59-955
ggcctatgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagctggcaggagcaggccgggtggcccagcctgggcccctggagcctgaggagccgagagctggaggcaggcctcggcgccggagggacctgggcagccgcctacaggcccagcgtcgagcccagcgggtggcctgggcagaagcagatgagaacgaggaggaagctgtcatcctagcccaggaggaggaaggtgtcgagaagccagcggaaactcacctgtcggggaaaattggagctaagaaactgcggaagctggaggagaaacaagcgcgaaaggcccagcgtgaggcagaggaggctgaacgtgaggagcggaaacgactcgagtcccagcgcgaagctgagtggaagaaggaggaggagcggcttcgcctggaggaggagcagaaggaggaggaggagaggaaggcccgcgaggagcaggcccagcgggagcatgaggagtacctgaaactgaaggaggcctttgtggtggaggaggaaggcgtaggagagaccatgactgaggaacagtcccagagcttcctgacagagttcatcaactacatcaagcagtccaaggttgtgctcttggaagacctggcttcccaggtgggcctacgcactcaggtaagccctggaacgtggcctgctgtgtgcagtgtggccaggggtctgtggctagcagagaggacctgccctaaagatagagtcttgatgcaccgtctaccttgtccccaaccaagagtgagtagtgcacagaagtctcctggcaccctgggaatcctgcatttttaatggacgaacaggcaggaaagaaaaaaaaaacccaaaccccatcactctgccagcccctgtgaccaaagcagcccaaatcagttaccttgacaactctcatgcacagactgcaccagcctgtgttgcaaacatcactgccccgcttctaacaggaagagatactcttttggggg

SEQ ID NO: 125164 - DNA, 2739 bp, Homo sapiens
  Payload ID: 4570
  Gene Symbol: DDX1
  Gene Name: DEAD (Asp-Glu-Ala-Asp) box helicase 1
  Uniprot ID: Q92499
  ENST ID: ENST00000233084
  CDS Start-End: 314-2536
ctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatg

SEQ ID NO: 125165 - DNA, 2817 bp, Homo sapiens
  Payload ID: 4570
  Gene Symbol: DDX1
  Gene Name: DEAD (Asp-Glu-Ala-Asp) box helicase 1
  Uniprot ID: Q92499
  ENST ID: ENST00000381341
  CDS Start-End: 390-2612
ggctcagatcccacgctgccattcggtagatatgtgtctttagataagtgacttaactttcccgaattttagagtcctcatctaaagattctaataccttcctgacagactgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctgtggaagagatggattggctcctcccaactgatatccaggctgaatctatcccattgatcttaggaggaggtgatgtacttatggctgcagaaacaggaagtggcaaaactggtgcttttagtattccagttatccagatagtttatgaaactctgaaagaccaacaggaaggcaaaaaaggaaaaacaacaattaaaactggtgcttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatgaa

SEQ ID NO: 125166 - DNA, 500 bp, Homo sapiens
  Payload ID: 4570
  Gene Symbol: DDX1
  Gene Name: DEAD (Asp-Glu-Ala-Asp) box helicase 1
  ENST ID: ENST00000434671
  CDS Start-End: 452-500
ggcattggtgctcagggcaatgaatccagtccatctctccgggtcattcacacaccaaggccctgctcacctttggaaagctgggggactgagtggggagggcacggtgtggtgtcagcctgagcccactggatgaccctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccgagatgggtgtaatgcctgagattgcacaagctg

SEQ ID NO: 125167 - DNA, 2257 bp, Homo sapiens
  Payload ID: 4570
  Gene Symbol: DDX1
  Gene Name: DEAD (Asp-Glu-Ala-Asp) box helicase 1
  ENST ID: ENST00000617198
  CDS Start-End: 84-2063
cggaagcgcgcgccgccactgccacgccgtgtcagtcgggagggagggagcgagcaggcgaagccgcggaggacggggtgaagatggcggccttctccgtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactat

SEQ ID NO: 125168 - DNA, 2183 bp, Homo sapiens
  Payload ID: 4570
  Gene Symbol: DDX1
  Gene Name: DEAD (Asp-Glu-Ala-Asp) box helicase 1
  ENST ID: ENST00000621973
  CDS Start-End: 1-1980
atgtctgatttttcagtgctgaacaaatggcagatgaacccatatgacagaggatctgcttttgcaattgggtcagatggtctttgttgtcaaagcagagaagtaaaggaatggcatgggtgtagagctactaaaggattaatgaaagggaaacactactatgaagtatcctgtcatgaccaagggttatgcagggtcgggtggtctaccatgcaggcctctttggacctaggtactgacaagtttggatttggctttggtggaacaggaaagaaatcccataacaaacaatttgataattatggagaggaattcactatgcatgataccattggatgttacctggatatagataagggacatgtcaagttctccaaaaatggaaaagatcttggtctggcatttgaaataccaccacatatgaaaaaccaagccctctttcctgcctgtgttttgaagaatgctgaactgaaatttaacttcggtgaagaggaatttaagtttccaccaaaagatggctttgttgctctttccaaggcaccggatggttacattgtcaaatcacagcactcaggtaatgcacaggtgacacaaacaaagtttctccccaatgctccgaaagctctcattgttgaaccttcccgggagttagctgaacaaactttgaacaacatcaagcagtttaagaaatacattgataatcctaaattaagggagcttctgataattggaggtgttgcagcccgggatcagctctctgttttggaaaatggagtagatatagttgtaggtactccgggaagactagatgacttggtgtcaactggaaagctgaacttatctcaagttagattcctggtcctggatgaagctgatgggcttctttctcaaggttattctgattttataaataggatgcacaatcagattcctcaggttacctctgatggaaaaagacttcaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagaactgatgatgtacatgcaaaagataacacaagacctggtgctaatagtccagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggacctgataaaaaaggacaccagttctcatgtgtttgtcttcatggtgacagaaagcctcatgagagaaagcaaaacttggaaagatttaagaaaggagatgtaagattcttgatttgcacagatgtagctgctagaggaattgatatccacggtgttccttatgttataaatgtcactctgcccgatgaaaagcaaaactacgtacatcgaattggcagagtaggaagagctgaaaggatgggtctggcaatttccctggtggcaacagaaaaagaaaaggtttggtaccatgtatgtagcagccgtggaaaagggtgttataacacaagactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatg

SEQ ID NO: 125169 - DNA, 4791 bp, Homo sapiens
  Payload ID: 4571
  Gene Symbol: DDX17
  Gene Name: DEAD (Asp-Glu-Ala-Asp) box helicase 17
  ENST ID: ENST00000396821
  CDS Start-End: 101-2296
aagttggagccgactcagcggcggccgccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtaagggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtctttcctttttttttcctcttcgccttttctttttttttccttttttctttttttttttttaatttttccccccaaccatcgtgatttgtcttttcatgcagattagttagaattcactgccaggtttcttctgcccaccaaaatgatccagtctggaataacattttgtaaaaaaaaaaaaaatatatatatatatatatagctgactggaagagattaatttcttcccccaacttcttgcatgttgaagatatttgagctatttttcatctaaaagagtaaggtattaggcccttttgtgggagccccatgttttgtttttctgagttggtggggagggagggagggggagggctgaattgttttgcagaggaagatggcatctgtgctttaaatttctcattactgggttagaaaacaaagagggattgccctgcacattttcttttgtgcttttaaatgtttcttaagttggaacaggtttcctcgggcctgttttgactgattgctggagtgcatttgatagttaaaaattactaattggttttatttcccttcacactctgcctccccacttctccccccgttactgaaaaataaccattttagtgtcaggctagaaattgaattgctgagttttgtgtatcctttaaattaaaaaccacaagtgtttattgtagtggttaaactgtagcatctcagcatctgggtggaagctgcctatatttcttcccagtttaactggggaccatctgtgaaattaattttccatccagacagctgctgtgagcaaatgaacataaatgctcgctggaaatttactaaccagtttttatattgacctgcagtgtaaaaagcacatttaattataaacaatatattcaaaatgggcaaattttattttcaaatgcagtgtagagctagattaaaagcaactctttgccacctactctgcccttttggcaaagttaccttgaacaaagaatcttaagggtttattaagaactctttattttcttcataccctgttctctgcagtgctttctaacagcttctgggtgcagattttcttcggcatccttttgcactcagcttattacaggtaggtagtgcttaagaaaagtcatggaggactaaagcctaagtccttttcacttttcctccatctgaaggtaggtgagttcatcctcttcatggtaatgctgttttaccaagactttatagcagatggacccagaaagaattttctgctattgtgttcactacaacaggatagggacatcagacagccccagaaaccccttccagatctgatatgggactattaatttttatgctgttaattggtattcattcacaatgcagttgaagggggaaggctccactgcattctttggctaaggcctgaatgcttgctcatctgtaagatctatactcgaggttttgttttccttttaaaattctttagggagagagggatggtttctgaggggttctgaaagtatgattcaatgtgcaacatacaggtaggtcttcagcataagctgaaatatatgcatgtaaaaactttgacatctttttttttaattttccactttcttcttaactttacttctctttttgtcccccccccatcttacagaagttgaggccaagggagaatggtaggcacagaagaaacatggcaaactgctctgtgctttcaaaccaaagtgttccccccaaccccaaatttgtctaagcactggccagtctgttgtgggcattgttttctacaaccaaattctgggtttttttcttctttctttaaacatagaggtaccaccacaagggatgccctactctctcgcagctcttgaaagcatctgtttgagggaaaggtctctgggcaagcaagtggttatttggattgcttgcttccctttttccacctgggacattgtaatcataaaataacagtaaattccaaacctcaaaaactattatggcctgagcacagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgcttctccccaatcctccctaacaattcgttgtgtggacttctcatctaaaaggttagtggcttttgcttgggatcagtgctctctattgatgttcttgctggtctccagacacattcctgttgcattaagacttgaaagacttgtagatgtgtgatgttcaggcacaggatgctgaaagctatgttactattcttagtttgtaaattgtccttttgataccatcatcttgttttctttttgtaggtataaataaaaacactgttgacaat

SEQ ID NO: 125170 - DNA, 2322 bp, Homo sapiens
  Payload ID: 4571
  Gene Symbol: DDX17
  Gene Name: DEAD (Asp-Glu-Ala-Asp) box helicase 17
  Uniprot ID: Q92841
  ENST ID: ENST00000403230
  CDS Start-End: 76-2265
cgccattttgtgcagtcgctgggaaggaaggagacgcctaaaccgcggcactgcccggtttgagcgtagccaaacctgcccaccggctttgtagccccgattctctgtgttttgctcccgtctccgacgagagaggcggcgacggtggcgtctgcgacgggagacagcgcgtcggagcgagagagcgctgcgcctgccgccgccccaacagcggaggcgccgccgccatcggtcgtcaccagaccggagccgcaggccctcccgagcccggccatccgtgccccgctcccagatctctatccttttgggaccatgcgcggaggaggctttggggaccgggaccgggatcgtgaccgtggaggatttggagcaagaggtggtggtggccttcccccgaagaaatttggtaatcctggggagcgtttgcgtaaaaaaaagtgggatttgagtgagctccccaagtttgagaaaaatttttatgtggaacatccggaagtagcaaggctgacaccatatgaggttgatgagctacgccgaaagaaggagattacagtgagggggggagatgtttgtcctaaacccgtgtttgccttccatcatgctaacttcccacaatatgtaatggatgtgttgatggatcagcactttacagaaccaactccaattcagtgccagggatttccgttggctcttagtggccgggatatggtgggcattgctcagactggctctgggaagacgttggcgtatctcctgcctgcaattgttcatattaaccaccagccatacttggaaaggggagatggcccaatctgtctagttctggctcctaccagagagcttgcccagcaagtacagcaggtggccgatgactatggcaaatgttctagattgaagagtacttgtatttatggaggtgctcctaaaggtccccagattcgagacttggaaagaggtgttgagatctgcatagccactcctggacgtctgatagatttcctggagtcaggaaagacaaatcttcgccgatgtacttaccttgtattggacgaagctgacagaatgcttgatatggggtttgaaccccagatccgtaaaattgttgaccaaatcaggcctgataggcagacactgatgtggagtgcaacctggccaaaagaagtaagacagcttgcagaggatttccttcgtgattacacccagatcaacgtaggcaatctggagttgagtgccaaccacaacatcctccagatagtggatgtctgcatggaaagtgaaaaagaccacaagttgatccaactaatggaagaaataatggctgaaaaggaaaacaaaacaataatatttgtggagacaaagagacgctgtgatgatctgactcgaaggatgcgcagagatggttggccagctatgtgtatccatggagacaagagtcaaccagaaagagattgggtacttaatgagttccgttctggaaaggcacccatccttattgctacagatgtagcctcccgtgggctagatgtggaagatgtcaagtttgtgatcaactatgactatccaaacagctcagaggattatgtgcaccgtattggccgaacagcccgtagcaccaacaagggtaccgcctataccttcttcaccccagggaacctaaaacaggccagagagcttatcaaagtgctggaagaggccaatcaggctatcaatccaaaactgatgcagcttgtggaccacagaggaggcggcggaggcgggggtggtcgttctcgttaccggaccacttcttcagccaacaatcccaatctgatgtatcaggatgagtgtgaccgaaggcttcgaggagtcaaggatggtggccggagagactctgcaagctatcgggatcgtagtgaaaccgatagagctggttatgctaatggcagtggctatggaagtccaaattctgcctttggagcacaagcaggccaatacacctatggtcaaggcacctatggggcagctgcttatggcaccagtagctatacagctcaagaatatggtgctggcacttatggagctagtagcaccacctcaactgggagaagttcacagagctctagccagcagtttagtgggataggccggtctgggcagcagccacagccactgatgtcacaacagtttgcacagcctccgggagctaccaatatgataggttacatggggcagactgcctaccaataccctcctcctcctccccctcctcctccttcacgtaaatgaaaccactcaagtggtagtgactccagcagacttaattacattttaaggaacactgtc

SEQ ID NO: 125171 - DNA, 443 bp, Homo sapiens
  Payload ID: 4571
  Gene Symbol: DDX17
  Gene Name: DEAD (Asp-Glu-Ala-Asp) box helicase 17
  ENST ID: ENST00000475004
  CDS Start-End: 1-169
ttggccagctatgtgtatccatggagacaagagtcaaccagaaagagattgggtacttaatgagttccgttctggaaaggcacccatccttattgctacagatgtagcctcccgtgggctaggttctccggcgcttggcaaccaaatggggctacagagaagcatctaagccagttcacagagcgagcgtgtgtggggacttctcactgccacggacccttgatgcatgctccccgcgctccagtggtcccgtgtcagaaggcggagttttcgaaaggaggccgccaaaaataaaaggcaaagagacgggatcggctgcagcggtttcccaaaggaggagggagtgtgcatcgatgtggaagatgtcaagtttgtgatcaactatgactatccaaacagctcagaggattatgtgcaccgtattggccgaacagcccgtagca

SEQ ID NO: 125172 - DNA, 4711 bp, Homo sapiens
  Payload ID: 4572
  Gene Symbol: DDX21
  Gene Name: DEAD (Asp-Glu-Ala-Asp) box helicase 21
  Uniprot ID: Q9NR30
  ENST ID: ENST00000354185
  CDS Start-End: 99-2450
gggaagtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtagggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttgatttta

SEQ ID NO: 125173 - DNA, 4829 bp, Homo sapiens
  Payload ID: 4572
  Gene Symbol: DDX21
  Gene Name: DEAD (Asp-Glu-Ala-Asp) box helicase 21
  Uniprot ID: Q9NR30
  ENST ID: ENST00000620315
  CDS Start-End: 427-2574
gggtcttggcgggcggtcgcccaggagtggtgcgctccccgggcagtggacgcgtcgtttgcccgaccgagccaggtccgccgtgcgctgacctcttcctctgagcttataggcatccacaggtcggaactctggtagagaggccctgttggagctcgggagagggccgggtgtcccacgtggtccccggcgacttgggcgcgcctcacacagtgcgcagagttggaccttcagtcaggctccacgttgttggctaagacagaactcccggcatgagcgtgcgcgaaggaagttacacgtcaagtcaaaaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtagggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttg

SEQ ID NO: 125174 - DNA, 2738 bp, Homo sapiens
  Payload ID: 4573
  Gene Symbol: DDX24
  Gene Name: DEAD (Asp-Glu-Ala-Asp) box helicase 24
  Uniprot ID: Q9GZR7
  ENST ID: ENST00000330836
  CDS Start-End: 71-2485
gtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaatt

SEQ ID NO: 125175 - DNA, 2214 bp, Homo sapiens
  Payload ID: 4573
  Gene Symbol: DDX24
  Gene Name: DEAD (Asp-Glu-Ala-Asp) box helicase 24
  ENST ID: ENST00000544005
  CDS Start-End: 117-1946
agttgctgctgcagctgaggtacagcggcggtttctgaggttcttcactcgcgactgacggagctgcggtggcgtctccacacggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcag

SEQ ID NO: 125176 - DNA, 2769 bp, Homo sapiens
  Payload ID: 4573
  Gene Symbol: DDX24
  Gene Name: DEAD (Asp-Glu-Ala-Asp) box helicase 24
  ENST ID: ENST00000555054
  CDS Start-End: 93-2543
agttgctgctgcagctgaggtacagcggcggtttctgaggttcttcactcgcgactgacggagctgcggtggcgtctccacacgatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttct

SEQ ID NO: 125177 - DNA, 2738 bp, Homo sapiens; identical to SEQ ID NO: 125174
  Payload ID: 4573
  Gene Symbol: DDX24
  Gene Name: DEAD (Asp-Glu-Ala-Asp) box helicase 24
  Uniprot ID: Q9GZR7
  ENST ID: ENST00000618456
  CDS Start-End: 71-2485

SEQ ID NO: 125178 - DNA, 2769 bp, Homo sapiens; identical to SEQ ID NO: 125176
  Payload ID: 4573
  Gene Symbol: DDX24
  Gene Name: DEAD (Asp-Glu-Ala-Asp) box helicase 24
  ENST ID: ENST00000614817
  CDS Start-End: 93-2543

SEQ ID NO: 125179 - DNA, 1730 bp, Homo sapiens
  Payload ID: 4573
  Gene Symbol: DDX24
  Gene Name: DEAD (Asp-Glu-Ala-Asp) box helicase 24
  ENST ID: ENST00000622786
  CDS Start-End: 35-1492
aaagagcagactggaaatctaaaacaggagttggatgacaaaagcgccatgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaac

SEQ ID NO: 125180 - DNA, 5612 bp, Homo sapiens
  Payload ID: 4573
  Gene Symbol: DDX24
  Gene Name: DEAD (Asp-Glu-Ala-Asp) box helicase 24
  Uniprot ID: Q9GZR7
  ENST ID: ENST00000621632
  CDS Start-End: 133-2712
agcgcgcacgagtacgtgcgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcagagccattgtgtcatcctgattttttttttttttttttagatagaagatgggggtggtggtgtagtttgtttcattattaacttagtgattctcctgggccagcacagtgctaagcccttgaaaggacaggaatagtgtcaggcctctggctgcaggccaagattggacagtgtgaatggagcaagaggctggaatgttcaagaggtgcatgttcctgctttacccagagcagcaccctaatagctccttagctctctccactctcctgggtattgtctgagccaccgtgggaggtgggcagggatgaggttgctgtcttcaggcttccctcacatcacagagccaacagtaacagtcgctaggtctggcgtgtgaagccctcaggatctagccccagccttgtctccactccctcctgtttgacagagcaggctcctgcccacggttccatgcaccccttctcttgtcctgagcctttgtgcagaataggcttttccctcggtctggattgccttttggccttctccatcctggagcactgccatgggtcctctagtcctgagcctctaaggggaagcagtgcttctcctggggctcccttagtgtcccgtgcttaccctcttcatagcacttgccatgctgtgttcccttagctgagctccttgggagaagaggaactcaaggcttggtcagcctggtataaatatgtgctcagggaactagggacttcctgatgctgccccagctttgtctggatcagtgtaggtgagtatccacaactcccacaaccatgggagaagcatagatgatttctgcacagctgtctggcttccaaacaggtattcgtcggggcacaatacaatacagctgtttagttcaaggggtgctagggaattgaagaggatacacaaagggaccaagataccccaagatctaagtagctagcctctctcagcctcatggttggcacttttatctaattagcatttagtcttgaaggtcctgagaaataattttcttttttttttgagacagggtcttgctccattgcccaggttggagtgcaatggcacaatcacagctcactgcaacctcacactcctgggcccaggcagtcctcccgcctcagcctcccaagtagctgggactacaggcacacaccaccacacctggctgaattttttttttttagtagagatggggtctcactatgttggcgtaggctggtctcaaaactcctgccctcaagtgatcctcttgcctcagcctcccaaagtactgagattacaggtgtgagccactgtgcccatctataagtctttattagtgttttttgtacttgagcatatagacacccagtgattgagacttgcccagggccacacagcagccaagtagcagaggtgggattagtatcttccttctgggcccaggacaagttcagaaaactacttcagtctcagaagtgttgccaaggaatggcctcccatcccccagtgtcaccagtgaccggaataggaggggaaattgcccgtctgtgaggtcagctcctgactgacagctatcagagaatggcagggagactctccattttccaaatgatgcagtggtggtcagtggggttagtaagcgggcttaatatcccctaatggcacctgagccgtgggagtgaagccacttgccataagccaaacatagatcccctgatgactgtccgtgtcctgccctagccatctaacagcaaattcttttccttggtggaggagctaatacgtagacaggctttaaaaggcaggagcagccttccaagcagtgctactctcgcctggtaaggtgaagttggtgggcagagcttccggagtgtcctggatctgccattaaacaaggaatatccctccccagctaatctacttaatacataagcaccacggaaaagcagagttcttggctgcatgccaggtacccagtattaagaagccaggacaaaagtagttatggaaaccattttaatgctaggagaatgtttttacttactgcctagggaagctgtagggcttggcccacatccagcagggcctggggcccctggaagccactcactgagttacagccccctccccactcctgtatctgctcagggtggtgatgtgtttgctcctagactctctctcatggttcccctgacactcctgcttgggaagccaccgagtcactgccaaggtgacatgcttccccatctgcagtgccctatgcttcctgtcaggaaggacaggttggggaatatccctttgcagagcccatacgatgagtgtgtcaggtataatagctattttcacacaaggaatctcattctgttttaaccaataatccagtgacacataggtattgttgccatttcacaaacttgggaattggggctcagggaggtgaagtgacttggccaagatcatacagctagtaagtgaatgctgaagttagaaccctggcattctggctccagagctctcatttgtgcttaaaataggaacccagtcaaaagcagggactgtgctctttctgttgctaattgttcccattgatttaaaagtttcctttggagagaaagtatcataataaacatgcagttgtaaaa

SEQ ID NO: 125181 - DNA, 2981 bp, Homo sapiens
  Payload ID: 4573
  Gene Symbol: DDX24
  Gene Name: DEAD (Asp-Glu-Ala-Asp) box helicase 24
  Uniprot ID: Q9GZR7
  ENST ID: ENST00000613280
  CDS Start-End: 133-2712
agcgcgcacgagtacgtgcgtggaggtcccgccccggaactgcagttgctgctgcagctgaggtacagcggcggtttctgaggttcttcactcgcgactgacggagctgcggtggcgtctccacacgcaaccatgaagttgaaggacacaaaatcaaggccaaagcagtcaagctgtggcaaatttcagacaaagggaatcaaagttgtgggaaaatggaaggaagtgaagattgacccaaatatgtttgcagatggacagatggatgacttggtgtgctttgaggaattgacagattaccagttggtctcccctgccaagaatccctccagtctcttctcaaaggaagcacccaagagaaaggcacaagctgtttcagaagaagaggaggaggaggagggaaagtctagctcaccaaagaaaaagatcaagttgaagaaaagtaaaaatgtagcaactgaaggaaccagtacccagaaagaatttgaagtgaaagatcctgagctggaggcccagggagatgacatggtttgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgaggccagagccaagactggaggcactgtctcagaccaggcgttgctctttggtgacgatgatgctggtgaagggccttcttccctgatcagggagaaacctgttcccaaacagaatgagaatgaggaggaaaatcttgataaagagcagactggaaatctaaaacaggagttggatgacaaaagcgccacctgtaaggcatatccaaagcgtcctctgcttggactggttctgactcccactcgagagctggccgtccaggtcaaacagcacattgatgctgtggccaggtttacaggaattaaaactgctattttggttggtggaatgtccacgcagaaacagcagaggatgctgaaccgtcgtcctgagattgtggttgctactccaggccggctgtgggaattaattaaagaaaagcattatcatttgaggaaccttcggcagctcaggtgcctggtagtggatgaggctgaccggatggttgagaaaggccattttgctgagctctcacagctgctagagatgctcaatgactcccaatacaacccaaagagacaaacgcttgttttttctgccacactcaccctggtgcatcaggctcctgctcgaatccttcataagaagcacaccaagaaaatggataaaacagccaaacttgacctccttatgcagaaaattggcatgaggggcaagcccaaggtcattgacctcacaaggaatgaggccacggtggagacgctaacagagaccaagatccattgtgagactgatgagaaagacttctacttgtactacttcctgatgcagtatccaggccgcagcttagtgtttgccaacagtatctcctgcatcaaacgcctctctgggctcctcaaagtccttgatatcatgcccttgaccctgcatgcctgtatgcaccagaagcagaggctcagaaacctggagcagtttgcccgtctggaagactgtgttctcttggcaacagatgtggcagctcggggtctggatattcctaaagtccagcatgtcatccattaccaggtcccacgtacctcggagatttatgtccaccgaagtggtcgaactgctcgagctaccaatgaaggcctcagtctgatgctcattgggcctgaggatgtgatcaactttaagaagatttacaaaacgctcaagaaagatgaggatatcccactgttccccgtgcagacaaaatacatggatgtggtcaaggagcgaatccgtttagctcgacagattgagaaatctgagtatcggaacttccaggcttgcctgcacaactcttggattgagcaggcagcagctgccctggagattgagctggaagaagacatgtataagggaggaaaagctgaccagcaagaagaacgtcggagacaaaagcagatgaaggttctgaagaaggagctgcgccacctgctgtcccagccactgtttacggagagccagaaaaccaagtatcccactcagtctggcaagccgcccctgcttgtgtctgccccaagtaagagcgagtctgctttgagctgtctctccaagcagaagaagaagaagacaaagaagccgaaggagccacagccggaacagccacagccaagtacaagtgcaaattaactggtcaagtgtgtcagtgactgcacattggtttctgttctctggctatttgcaaaacctctcccacccttgtgtttcactccaccaccaaccccaggtaaaaaagtctccctctcttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcaga

SEQ ID NO: 125182 - DNA, 1730 bp, Homo sapiens; identical to SEQ ID NO: 125179
  Payload ID: 4573
  Gene Symbol: DDX24
  Gene Name: DEAD (Asp-Glu-Ala-Asp) box helicase 24
  ENST ID: ENST00000619833
  CDS Start-End: 35-1492

SEQ ID NO: 125183 - DNA, 2214 bp, Homo sapiens; identical to SEQ ID NO: 125175
  Payload ID: 4573
  Gene Symbol: DDX24
  Gene Name: DEAD (Asp-Glu-Ala-Asp) box helicase 24
  ENST ID: ENST00000626330
  CDS Start-End: 117-1946

SEQ ID NO: 125184 - DNA, 7555 bp, Homo sapiens
  Payload ID: 4574
  Gene Symbol: DDX25
  Gene Name: DEAD (Asp-Glu-Ala-Asp) box helicase 25
  Uniprot ID: Q9UHL0
  ENST ID: ENST00000263576
  CDS Start-End: 156-1607
agccttccagcgcctgcgcgccgcaccgcggtggtcgcgggcgcggacgcggacgcctgccccctaaggaagcccattggccagcggatggggccagcaccgcctcgcgccggtggtggaagcacgtgctgggggcgggagcagcaatcgcagccatggcgtcgttactgtggggaggcgacgcaggggcggcggagagcgagcggctgaacagccacttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttggcaatgttaagcagagttaatgccttggaattgttcccacagtgcctctgcctagctcctacttatgaattggctctgcaaactggccgtgtggttgagcagatgggaaaattctgtgtggatgttcaagtgatgtatgccattcgagggaatcgaattcccagaggcaccgacatcactaaacagattataattggcactcctgggactgtcctagattggtgttttaaactaaaattgattgatttgactaagattcgtgtgtttgtcctggatgaagcagatgtgatgattgacactcaaggattctcagatcatagtattcgtattcaaagagctctaccctccgaatgccaaatgctcctcttttcagcaacctttgaggactctgtgtggcactttgctgagcgaatcatccctgaccctaatgttatcaagttacgcaaagaggagctcacactgaacaacatccggcaatattacgtgctgtgtgagcacaggaaagacaaataccaagctctgtgcaacatttatggcagcatcaccattggtcaggccatcatcttctgccagactcgtcgaaacgctaagtggttgaccgtggagatgatacaggatggccaccaggtgtctttgttaagcggggagctgaccgtggagcagcgagcttccatcattcagaggtttcgggatgggaaagagaaggttctcataacaactaatgtttgtgcccgagggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttaacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagacatgaggtctttttgaagccaaattgatgtgaagcttgtgatccttttgaataaaaaaaaggcaagattatttcttattctaatctttgtacaggtaatgtctcaatgtgggctatgggggtgtttttggatttggttgatacaatctgagcagatcgtgcctcttgggagcatcttactgtgtcacaagagggcggtagagcttcgctgattttggaagcggagcgagtaggaaaaagcccatgtcttcagacctcactcacaggtgccctttccagccatttatgcctttccccgctccccgccttaaactcccccatgcatgcacatgcatgttcttaagtgaaagtacagattaaaacttttaaaaagtgaaaccatttgaaagaaagagtattttacttctttaatgtttcaagggacatacagaatttcagagtatttttctattttgcttctcttcaaattaaagatttactccctcatcagttatttcatagtctctaaaagtgtggctgtattatgggcatttcttaaaagcagtcgggagggtaaaaaaaaaacccacataccctattaaagaagtaacattttagagagcaaaagttttttgcttttaagaatttaaaggtatgtcagaatcctggacattttcccacaagacccattgagatactttttaatttttcatatttcctactcaaaagtaaagtgtagtgagcttgagaagatggggtaaatggagagtcccccagaaagccggagcggatcttgtaaccagagcgccggtaccagctctgtcacggcaccaaactgcaccagtggctgcagtgagtggccctgtcatcggtggcatggtggttcctggcatatctattttgatatccctcttccatgtcaccctgcccatgttttctcccggagagcagggctcagaaatacataaaaatcatcacgtggctgggcacagtggctcacacctgtaatcctagcactttgggaggccaaggagggcggatcacgaggtcaggagttaagaccagccttaccaacatggtgaaaccccttctctactaaaaatataaaaattagctgggcgtggtggtacgcgtgcctgtaatcccagctactcaggaggctgaggcaggagaatcacttgaacccaggaggccgagattgcagtgagccgagatcgtgccactgcattccagcctgggcgacagagtgagactctatctcaaaaaaaacgcgctcccctccctcatttagcaacagatatttattgtataccctttatgccaaacaccagggaaaaggaggtgagtgagatacaacagccatgttggaattcagagcctaatggcagagacctagaataagccagcatgataacagactgtgctaaagcaagcgggcccagatcactagtgtagcacagaggagggaccctaacaccatctaggctggctcccagaggagaggacactcaggatctcctacaggagagcaggatgtattcaactgtgccttctcagcatggactttgtaccacccagcaactttctaacctgagtctacgagaggaagtgttccagacccagcttaccataattacctggagagcccggggaaaaaaatacagatttccttccccatgcagatgaaagcagactctccgagggcagagcccagaaatacccacttccataagggagccgcaagtgcaggtagagcagtggtaacgaagatggccgtcccagcgggagaccctcaggcagagaggcccttggggacagaacttgtaacacatggaactcctgctgctcggtgtccatcctggttctccttatcctacatctgcccttctctctggactggaagctggtgatcactcttgtccactcaatacccctaacacagtgcccagtgcattctaagtgcccaaggaacctttgtctttgttgagtaaatttttttttcttttgccacttcctcattcactaataatttttttttaggttttccatcctagttttgaaccccaattacatggcacaggatgaatgagcatgagaagtgtatccagatactttgttctcttactattcgagaatcgagttggaccttccaccgtgctcagctccgccttggggtgtcctaaataaaactttaccactttcctttacagttcaaatctctggtaagatctccgccagttaccctcacaaatgtcctcagtaatttttgtttggcagctgttcccacaggtctgcatgaaccaggtatttttctgcgttcccttttgccccctcctcacgtccctttgtctcaccacctaggaggcagcaaagccatcctgtgtcacagctgcattaacacgaactggctagtttggtgagtcaacaatccaaaggctgttttttgcagggtgcagctcctgtcagagctgtaagcaattttcccgtcttcctgcatggcctggccaaggtcatctctctcagtgcctgcctgaggacagagtagatagagaggcaaggaaacaccaggtgatttcagtgcaactgtgagctgggttcatcagctgtatgtttcttggcaccaaatactaaaccaaatccgttaagtttatcttggccagcttaatactgttagcatattgaaattcatgattacgtagagcaggactgtgatttccagtgggtaagtgaacacctcgcatggaacacggctgctatgatgttaggtgctggatctaaggcaaccattaataataggaaaggcaaataagttggtcatagtctggtaggatgtgtgacagccgcttttcaagagacattattgcttttggtcatgagaaagtgttgatcctcctcagcaaagctcggtcaccatgaaagctgctggcagtctctgcacatatgaccaacagtggaaaatcttagaggagtgatgggggtggtgggtggtgggcagtacctttccagacagcagagagagagaggctggttttgtcaagccttggcttggttcctggtcctctgagaggctcagtctccttccttttgattcaaggcaggacctagattagaaagagaacccctgcagagacagtccagctgttgggatgggcctgcactttgctctctgaaccggggggcattactatgttctcacccacattgtacagacagcccatcatgctcagccttgcaggagggtcttcaggagcccagccatctggcacatactgcttttcccaagggagtaacagaaaggtcagatcctcttcaatcctaaccctctcacttcaactctccactacttctggggaataatgatgtattatccaagaccctcatatcatattaacccacagactatgaaatcatcacagtcttgttctatgctacagggaatacgaactttttgccctagaaagcatccaagaggcactcaaccccaacattttctatacttttgctaatccgtggctgagagaatttgacattttcccttctcttttttttttttttgagatggagtctcactgtgttgcccaggctggagtgcagtggcgtgatctcggctcactgcaaactctgcctccccggttcaagcaattctcctgtctcagcctcccgagtagctggggctacaggcacatgccaccacgcctggcttatttttgtatgttattttagtagcgatggggtttcaccgtattggtcaggctggtctcgaactcgtgacctcaggtgatccacacgccttggcttcccaaagtgctgggattacaggcatcagccacggcgcccagcctccccttctcatttctgtctgctgactcctcttcccgttctgctgctcacatccgcaggttgatgttttcaccctcggggttctgccttatcccctgccaccctcctgtgctgcctgggtccctcagaaggatgggtctggacttcccacaccctccttcgctgcccctcactgtgttgcctggtgtctgcctgaagagatgcagtttgagccattggctggtttctcttactgctttgcaaactatcagttttaaatgtgggtggggctgaagcaccattctccatttttaatgtggattttccatccccctttaaacattaaacttttagattcttctagtgaaatacagaaaacacacgtgaactgggatgattcttggctgagagatgtcccatggtgtttggcaaacccacggaggggcccacaggcccatgtctggaactgcctggccctcctttaccagtttatcagccttccatctctgctgaggtagaaacagccagaggctctgatataataaagatgagctctgaagaggggctctctctccctcttgtattcagaagaactgaaagttttcataagtctctagagaagcgtggcaactatctgtagcatttttctttgggaattaacctttgcccataattatttctgttcagtagaataaccatgggtttctctattccagtttctagaatataattttcataaatgaggatggtctcctattttgagcttaacatttttctattgctagaaagaatggtactgcctcactccagctccttagtgtgtgatcatggcttgaaatctctgctttctgttatattcggaggtaacatgtataggtcatgtataatggcctcaggcatgatttagaaggcacagactgagcaggctgctttgtgaggtggtgaactccccattcatgagagcattcaatcaatcagaagatgaatagttaatcagatgctgtagttctggttcttgaataaccaggagttcagaataaaatgatctcggagactctgtccattctaagataccatgtttccatgaccctacacacaatagctacacaggtggagcaacatgagtctgagaagctttgcacaaaagaagattgttttccacaaatgaaaatggggtggttaacttctaattgtaccctgtcttagcgttcagatgcattggttccttccccatgtgaccatctcttcattcaaagcttaggctgaatgtggattatttttaatttaatgttcatattataaaagcaatgaaacagcaaagtagagcaaaatatcaacaatccaatgactttatcataaaaattatcagcttgatatagtcctgttcttaatataaacatctgtggttaattatagtattatatctttttatttgaaacattcaagttttttttcatgttaccacacagtgtttgggattatattttcaaaataataattgaccagattgtcctatctagtgaatatgcatatagctgactttgttgaacatttataggatgtccatttttccaaagctttaattataaatcatgctgcagtaaatatcttctcgcccaatattccgaattatttcttaagattagagacattaagtgcgagtaccaggtcgaaaactagaagcactttaacagcatttaacagattttgttagagctacattgcattcagtagactggctataccaatatatagttgcacagcaaattcacctcaccttaccagcaagggatattttcattttaaaattgcttggtaacttttctggtttatgtttctcttagtacaagcaagattatattttttaaagtggttcatcatttgaaaagcatctgtagtgttctttgcccatttatcttgtgggatgttaatggtttccttgtcaagttgtgtgaaatatatgtgtgaatttatttttccaaataaaataaagacattaaccttc

SEQ ID NO: 125185 - DNA, 574 bp, Homo sapiens
  Payload ID: 4574
  Gene Symbol: DDX25
  Gene Name: DEAD (Asp-Glu-Ala-Asp) box helicase 25
  ENST ID: ENST00000530129
  CDS Start-End: 1-574
gcgagcgttcgaagtggggcgtcagatgctggaggggagatgcgggaagggtttggaagagggccacagagggagaccccgtccccacccccacgagagttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttggcaatgttaagcagagttaatgccttggaattgttcccacagtgcctctgcctagctcctacttatgaattgg

SEQ ID NO: 125186 - DNA, 1445 bp, Homo sapiens
  Payload ID: 4574
  Gene Symbol: DDX25
  Gene Name: DEAD (Asp-Glu-Ala-Asp) box helicase 25
  ENST ID: ENST00000526875
  CDS Start-End: 1-1222
tctagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttggcaatgttaagcagagttaatgccttggaattgttcccacagtgcctctgcctagctcctacttatgaattggctctgcaaactggccgtgtggttgagcagatgggaaaattctgtgtggatgttcaagtgatgtatgccattcgagggaatcgaaattggtgttttaaactaaaattgattgatttgactaagattcgtgtgtttgtcctggatgaagcagatgtgatgattgacactcaaggattctcagatcatagtattcgtattcaaagagctctaccctccgaatgccaaatgctcctcttttcagcaacctttgaggactctgtgtggcactttgctgagcgaatcatccctgaccctaatgttatcaagttacgcaaagaggagctcacactgaacaacatccggcaatattacgtgctgtgtgagcacaggaaagacaaataccaagctctgtgcaacatttatggcagcatcaccattggtcaggccatcatcttctgccagactcgtcgaaacgctaagtggttgaccgtggagatgatacaggatggccaccaggtgtctttgttaagcggggagctgaccgtggagcagcgagcttccatcattcagaggtttcgggatgggaaagagaaggttctcataacaactaatgtttgtgcccgagggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttaacagcagtattaagcaactcaacgctgaagacatggatgaaattgaaaagattgactattgaagaaagaactttattgtttgtgcagtatcctagtttatgtgagaatgtctcagtgggttttgaaggtaatttttttatgttgaggctttttcgacgtgaaactgtcacagatggcaaaataaatgtcacggtacttagttttaagacatgaggtctttttgaagccaaattgatgtgaagcttgtgatccttttgaataaaaaaaaggcaagattatttctta

SEQ ID NO: 125187 - DNA, 2276 bp, Homo sapiens
  Payload ID: 4574
  Gene Symbol: DDX25
  Gene Name: DEAD (Asp-Glu-Ala-Asp) box helicase 25
  ENST ID: ENST00000530414
  CDS Start-End: 1-1407
atcgcagccatggcgtcgttactgtggggaggcgacgcaggggcggcggagagcgagcggctgaacagccacttttcaaacctcagccaaccccggaagaacctttggggtattaagagtactgcagtccgaaacatagatggttctattaataacatcaatgaagatgatgaagaagatgtagtggatttggcagctaattcactcttaaacaagttaatccatcaatccttagtagaatccagtcaccgtgtggaagttttacagaaggatcccagctctccactttactcagtaaagacatttgaagagctgcggctaaaggaagagttactaaaaggaatctatgcaatgggatttaataggccatctaaaatccaagagatggctctccctatgatgctggcacatccaccccagaacctcatagcacagagccagtctggaacaggaaagacagcggcatttgtgttggcaatgttaagcagagttaatgccttggaattgttcccacagtgcctctgcctagctcctacttatgaattggctctgcaaactggccgtgtggttgagcagatgggaaaattctgtgtggatgttcaagtgatgtatgccattcgagggaatcgaattcccagaggcaccgacatcactaaacagattataattggcactcctgggactgtcctagattggtgttttaaactaaaattgattgatttgactaagattcgtgtgtttgtcctggatgaagcagatgtgatgattgacactcaaggattctcagatcatagtattcgtattcaaagagctctaccctccgaatgccaaatgctcctcttttcagcaacctttgaggactctgtgtggcactttgctgagcgaatcatccctgaccctaatgttatcaagttacgcaaagaggagctcacactgaacaacatccggcaatattacgtgctgtgtgagcacaggaaagacaaataccaagctctgtgcaacatttatggcagcatcaccattggtcaggccatcatcttctgccagactcgtcgaaacgctaagtggttgaccgtggagatgatacaggatggccaccaggtgtctttgttaagcggggagctgaccgtggagcagcgagcttccatcattcagaggtttcgggatgggaaagagaaggttctcataacaactaatgtttgtgcccgagggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttagtaagtagcaccaccctcacaatatgaactacagacctgccggtctgacagtgatgatgtgtgctggagagctggagtccaggggctcatgagagtagtagaagcagaatgcatgagctggaaggcttctaattcacaggaccagggttctaatatgagacagatgattaaataatgcttatatggtaattaaaaattattttgatcaagcagaattaatatgagctcaggccgggtgtggcagctcacacctgtaatcccagcactttgggaggccgaggtggtcagatcatgaggtcaggaaatccagaccatcctggccaacatggtaaaaccccatctctactaacaatacaaaaattagctgggcgtggtggcacatgcctgtagtctcagctgctggagaggctgaggcaggagaatcgcttgaacccaggaggcggaggttgcagtgagctgaggtcgcacaactgcactccagcctggcgaaagagtgagactgcgtctcaaaaaaataaaatttgagctcagatttacatgttataactcattctggagtcagaatttcacatcttgtgaaggcagagcagattacagaagcagattttcgtatcttataaagaaattccctaagcaaagtagtaacatcctttaagattctcttcagttctcctcttttacttacgctttttccctcctcttgcccaccctcccaaacaggaaagtcctaaattctgaagtccgcgacctttcctccagccccccatctaaacaaggcaggctctgatgatggcctgctggaactctggactggcagatttctctgatggaaactcaaaaggtcccatggttcaaattgtcctgtgccccaaagccc

SEQ ID NO: 125188 - DNA, 460 bp, Homo sapiens
  Payload ID: 4574
  Gene Symbol: DDX25
  Gene Name: DEAD (Asp-Glu-Ala-Asp) box helicase 25
  ENST ID: ENST00000584970
  CDS Start-End: 1-202
agggattgatgtgaagcaggtcacaattgttgtgaactttgatctccctgtaaaacaaggagaggagccggactatgagacctacctccaccgcatagggcggacggggcgctttgggaaaaaaggccttgccttcaacatgattgaagtagatgagctgccctcgctcatgaaaatccaggaccactttagaaagtcctaaattctgaagtccgcgacctttcctccagccccccatctaaacaaggcaggctctgatgatggcctgctggaactctggactggcagatttctctgatggaaactcaaaaggtcccatggttcaaattgtcctgtgccccaaagcccatggatgtggctggggagcaggggagaaggaacaccttccaggacagtgacagcagtattaagcaactcaacgctgaagacatggatgaaattgaaaagattgactattgaa

SEQ ID NO: 125189 - DNA, 5399 bp, Homo sapiens
  Payload ID: 4575
  Gene Symbol: DDX3X
  Gene Name: DEAD (Asp-Glu-Ala-Asp) box helicase 3, X-linked
  Uniprot ID: O00571
  ENST ID: ENST00000399959
  CDS Start-End: 856-2844
ctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctgaaaaa

SEQ ID NO: 125190 - DNA, 5346 bp, Homo sapiens
  Payload ID: 4575
  Gene Symbol: DDX3X
  Gene Name: DEAD (Asp-Glu-Ala-Asp) box helicase 3, X-linked
  Uniprot ID: O00571
  ENST ID: ENST00000457138
  CDS Start-End: 856-2796
ctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcagtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctg

SEQ ID NO: 125191 - DNA, 1051 bp, Homo sapiens
  Payload ID: 4575
  Gene Symbol: DDX3X
  Gene Name: DEAD (Asp-Glu-Ala-Asp) box helicase 3, X-linked
  ENST ID: ENST00000441189
  CDS Start-End: 92-511
agagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaa

SEQ ID NO: 125192 - DNA, 3397 bp, Homo sapiens
  Payload ID: 4575
  Gene Symbol: DDX3X
  Gene Name: DEAD (Asp-Glu-Ala-Asp) box helicase 3, X-linked
  Uniprot ID: O00571
  ENST ID: ENST00000478993
  CDS Start-End: 856-2844
ctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggatcatgctcctctgtggagcaagtgcctccatgaaatgccatattttgtgaagaaagtgcatgcaggaatattcaggagtccagcatgtagtcatggcagccttaggtatttgagaccgaccaaccctcctgatgaagacaaccataactcatgcagaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctca

SEQ ID NO: 125193 - DNA, 630 bp, Homo sapiens
  Payload ID: 4575
  Gene Symbol: DDX3X
  Gene Name: DEAD (Asp-Glu-Ala-Asp) box helicase 3, X-linked
  ENST ID: ENST00000611968
  CDS Start-End: 1-416
gtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaa

SEQ ID NO: 125194 - DNA, 485 bp, Homo sapiens
  Payload ID: 4575
  Gene Symbol: DDX3X
  Gene Name: DEAD (Asp-Glu-Ala-Asp) box helicase 3, X-linked
  ENST ID: ENST00000615742
  CDS Start-End: 92-388
agagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaagtgtggtgaactgaccccacgtgcctaatagctgtggttagtcctgtgtcctgatttttcgcaaacaggcctaaaactcttaaaaacatcttagttcaggtttgatgatcg

SEQ ID NO: 125195 - DNA, 3237 bp, Homo sapiens
  Payload ID: 4575
  Gene Symbol: DDX3X
  Gene Name: DEAD (Asp-Glu-Ala-Asp) box helicase 3, X-linked
  ENST ID: ENST00000625837
  CDS Start-End: 906-3107
atttccccccgactcccgccccggtcaccatcctaccctcctccctcctcctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggagggagctcaaggtcacaagaagaaatgaaaggaacaatcagcagccctgttcagaaggatcatgctcctctgtggagcaagtgcctccatgaaatgccatattttgtgaagaaagtgcatgcaggaatattcaggagtccagcatgtagtcatggcagccttaggtatttgagaccgaccaaccctcctgatgaagacaaccataactcatgcaggcatgagtctaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctca

SEQ ID NO: 125196 - DNA, 3013 bp, Homo sapiens
  Payload ID: 4575
  Gene Symbol: DDX3X
  Gene Name: DEAD (Asp-Glu-Ala-Asp) box helicase 3, X-linked
  ENST ID: ENST00000626301
  CDS Start-End: 906-2828
atttccccccgactcccgccccggtcaccatcctaccctcctccctcctcctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggagaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctca

SEQ ID NO: 125197 - DNA, 3181 bp, Homo sapiens
  Payload ID: 4575
  Gene Symbol: DDX3X
  Gene Name: DEAD (Asp-Glu-Ala-Asp) box helicase 3, X-linked
  ENST ID: ENST00000630858
  CDS Start-End: 906-2849
atttccccccgactcccgccccggtcaccatcctaccctcctccctcctcctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggatcatgctcctctgtggagcaagtgcctccatgaaatgccatattttgtgaagaaagtgcatgcaggaatattcaggagtccagcatgtagtcatggcagccttaggtatttgagaccgaccaaccctcctgatgaagacaaccataactcatgcaggcatgagtctaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctca

SEQ ID NO: 125198 - DNA, 3457 bp, Homo sapiens
  Payload ID: 4575
  Gene Symbol: DDX3X
  Gene Name: DEAD (Asp-Glu-Ala-Asp) box helicase 3, X-linked
  Uniprot ID: O00571
  ENST ID: ENST00000629785
  CDS Start-End: 906-2894
atttccccccgactcccgccccggtcaccatcctaccctcctccctcctcctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggatcatgctcctctgtggagcaagtgcctccatgaaatgccatattttgtgaagaaagtgcatgcaggaatattcaggagtccagcatgtagtcatggcagccttaggtatttgagaccgaccaaccctcctgatgaagacaaccataactcatgcaggcatgagtctaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctca

SEQ ID NO: 125199 - DNA, 3289 bp, Homo sapiens
  Payload ID: 4575
  Gene Symbol: DDX3X
  Gene Name: DEAD (Asp-Glu-Ala-Asp) box helicase 3, X-linked
  Uniprot ID: O00571
  ENST ID: ENST00000630255
  CDS Start-End: 906-2894
atttccccccgactcccgccccggtcaccatcctaccctcctccctcctcctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaagaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctca

SEQ ID NO: 125200 - DNA, 3120 bp, Homo sapiens
  Payload ID: 4575
  Gene Symbol: DDX3X
  Gene Name: DEAD (Asp-Glu-Ala-Asp) box helicase 3, X-linked
  ENST ID: ENST00000630370
  CDS Start-End: 906-2849
atttccccccgactcccgccccggtcaccatcctaccctcctccctcctcctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaaggccagtgttaggaaaaaaaaaacaaaaacaaaaaaaacgaaaaacgaaagctgagtgcatagagttggaaaggggagcgaatgcgtaaggttggaaaggggggcgaagaggcctaggttaacattttcaggcgtcttagccggtggaaagcgggagacgcaagttctcgcgagatctcgagaactccgaggctgagactagggttttagcggagagcacgggaagtgtagctcgagagaactgggacagcatttcgcaccctaagctccaaggcaggactgctaggggcgacaggactaagtaggaaatcccttgagcttagacctgagggagcgcgcagtagccgggcagaagtcgccgcgacagggaattgcggtgtgagagggagggcacacgttgtacgtgctgacgtagccggctttccagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggatcatgctcctctgtggagcaagtgcctccatgaaatgccatattttgtgaagaaagtgcatgcaggaatattcaggagtccagcatgtagtcatggcagccttagaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttttcttctggccctcttattacatgagaaaaataaacacctatgcaccttggcctca

SEQ ID NO: 125201 - DNA, 5023 bp, Homo sapiens
  Payload ID: 4575
  Gene Symbol: DDX3X
  Gene Name: DEAD (Asp-Glu-Ala-Asp) box helicase 3, X-linked
  Uniprot ID: O00571
  ENST ID: ENST00000629496
  CDS Start-End: 480-2468
atttccccccgactcccgccccggtcaccatcctaccctcctccctcctcctttccccttactccgctcccctcttttccctccctctcctccccttccctctgttctctcctcctcttcccctcccctcccccgtccggagcactctatattcaagccaccgtttcctgcttcacaaaatggccaccgcacgcgacacctacggtcacgtggcctgccgccctctcagtttcgggaatctgcctagctcccactaaggggaggctacccgcggaagagcgagggcagattagaccggagaaatcccaccacatctccaagcccgggaactgagagaggaagaagagtgaagcgggtatattagatccgtggccgcgcggtgcgctccagagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcaaagggcgctatattcctcctcatttaaggaaccgagaagctactaaaggtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaaagtttcagtgatgttgagatgggagaaattatcatgggaaacattgagcttactcgttatactcgcccaactccagtgcaaaagcatgctattcctattatcaaagagaaaagagacttgatggcttgtgcccaaacagggtctggaaaaactgcagcatttctgttgcccatcttgagtcagatttattcagatggtccaggcgaggctttgagggccatgaaggaaaatggaaggtatgggcgccgcaaacaatacccaatctccttggtattagcaccaacgagagagttggcagtacagatctacgaggaagccagaaaattttcataccgatctagagttcgtccttgcgtggtttatggtggtgccgatattggtcagcagattcgagacttggaacgtggatgccatttgttagtagccactccaggacgtctagtggatatgatggaaagaggaaagattggattagacttttgcaaatacttggtgttagatgaagctgatcggatgttggatatggggtttgagcctcagattcgtagaatagtcgaacaagatactatgcctccaaagggtgtccgccacactatgatgtttagtgctacttttcctaaggaaatacagatgctggctcgtgatttcttagatgaatatatcttcttggctgtaggaagagttggctctacctctgaaaacatcacacagaaagtagtttgggtggaagaatcagacaaacggtcatttctgcttgacctcctaaatgcaacaggcaaggattcactgaccttagtgtttgtggagaccaaaaagggtgcagattctctggaggatttcttataccatgaaggatacgcatgtaccagcatccatggagaccgttctcagagggatagagaagaggcccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagtagcagatttagtggagggtttggtgccagagactaccgacaaagtagcggtgccagcagttccagcttcagcagcagccgcgcaagcagcagccgcagtggcggaggtggccacggtagcagcagaggatttggtggaggtggctatggaggcttttacaacagtgatggatatggaggaaattataactcccagggggttgactggtggggtaactgagcctgctttgcagtaggtcaccctgccaaacaagctaatatggaaaccacatgtaacttagccagactataccttgtgtagcttcaagaactcgcagtacattaccagctgtgattctccactgaaattttttttttaagggagctcaaggtcacaagaagaaatgaaaggaacaatcagcagccctgttcagaaggtggtttgaagacttcattgctgtagtttggattaactcccctcccgcctacccccatcccaaactgcatttataattttgtgactgaggatcatttgtttgttaatgtactgtgcctttaactttagacaactttttattttgatgtcctgttggctcagtaatgctcaagatatcaattgttttgacaaaataaatttactgaacttgggctaaaatcaaaccttggcacacaggtgtgatacaacttaacaggaatcatcgattcatccataaataatataaggaaaaacttatgcggtagcctgcattagggctttttgatacttgcagattgggggaaaacaacaaatgtcttgaagcatattaatggaattagtttctaatgtggcaaactgtattaagttaaagttctgatttgctcactctatcctggataggtatttagaacctgatagtctttaagccattccagtcatgatgaggtgatgtatgaatacatgcatacattcaaagcactgttttcaaagttaatgcaagtaaatacagcaattcctctttcaacgtttaggcagatcattaattatgagctagccaaatgtgggcatactattacagggaaagtttaaaggtctgataacttgaaataggtttttaggagaattcatctacttagactttttaaatgcctgccataaatgaaattgaaatggtagaatggctgaccacagcaatgaccagccctcattagggccctggatgatttttggtctaataacgcatgctagtgttgatgttttttggtcaagagggtatgaacaggaagaattaaatgcagcaggctttattttaaatgccgattcacattactctgttcaagctgcgttgagatgttaaactggcttactatagacttcgtaaaaatggctccagaagagtaacaaactgaaatctttgagatcacacaggttggaaatatgtacataactgcacaaggtgtcaattctgctctacagtgcagttttagtcagttttagttgcataggtttccattgtatttatagtctgtttatgctaaatctggccaaagatgagcattgtccaccactaaaatgcctctgccactttgaattctgtgctaattttgtggccagaatgcggtgatcaaaacgctccatctttttacagtggcataggaagacggcaaaaatttcctaaagtgcaatagattttcaagtgtattgtgccttgttctaaaacttttattaagtaggtgcacttgacagtattgaggtcatttgttatggtgctatttcaattagtctaggtttaggcccttgtacattttgcccataactttttacaaagtacttcttttattgcacattcagagaattttatatatatgtcttgtgtgcgtgtccttaaacttccaatcttactttgtctcttggagattgttgaacgcagcttgtctaggaaggggatgggactagattctaaaatttatttgggaccatgggaatgatagttgggaagaaaactatttgcacacgacagatttctagatactttttgctgctagttttatgtaatatttattgaacattttgacaaatatttatttttgtaagcctaaaagtgattctttgaaagtttaaagaaacttgaccaaaagacagtacaaaaacactggcacttgaatgttgaatgtcaccgtatgcgtgaaattatatatttcggggtagtgtgagcttttaatgtttaagtcatattaaactcttaagtcaaattaagcagacccggcgttggcagtgtagccataactttctgatgttagtaaaaacaaaattggcgacttgaaattaaatcatgccaaggttttgatacacttgtcttaagatattaatgaaacacttcaaaacactgatgtgaagtgtccagattctcagatgtttgttgtgtggattttgtttagttgtgtgtttttttttttttttcagtgaatgtctggcacattgcaatcctcaaacatgtggttatctttgttgtattggcataatcagtgacttgtacattcagcaatagcatttgagcaagttttatcagcaagcaatattttcagttaataaggtttcaaaaatcatgtaaggatttaaacttgctgaatgtaaagattgaacctcaagtcactgtagctttagtaattgcttattgtattagtttagatgctagcactgcatgtgctgtgcatattctgattttattaaaataaaaagttgaactgcacagtctcctttgttgttgtcaattgtggtttattttcagaggtgtaaataaagtgctcttgcctgaaaaa

SEQ ID NO: 125202 - DNA, 818 bp, Homo sapiens
  Payload ID: 4575
  Gene Symbol: DDX3X
  Gene Name: DEAD (Asp-Glu-Ala-Asp) box helicase 3, X-linked
  ENST ID: ENST00000616050
  CDS Start-End: 1-494
cccttcaccagttccgctcaggaaaaagcccaattttagtggctacagcagtagcagcaagaggactggacatttcaaatgtgaaacatgttatcaattttgacttgccaagtgatattgaagaatatgtacatcgtattggtcgtacgggacgtgtaggaaaccttggcctggcaacctcattctttaacgagaggaacataaatattactaaggatttgttggatcttcttgttgaagctaaacaagaagtgccgtcttggttagaaaacatggcttatgaacaccactacaagggtagcagtcgtggacgttctaagagcagatttagtggagggtttggtgccagagactaccgacaaagtagcggtgccagcagttccagcttcagcagcagccgcgcaagcagcagccgcagtggcggaggtggccacggtagcagcagaggatttggtggaggatcatgctcctctgtggagcaagtgcctccatgaaatgccatattttgtgaagaaagtgcatgcaggaatattcaggagtccagcatgtagtcatggcagccttaggtatttgagaccgaccaaccctcctgatgaagacaaccataactcatgcaggcatgagtctcaaagcctcacaagaggcttttggctctgctcttttttctctcctagaacttggagcgtgatgcccagaagtgtgtgaactggtctgtgaccacaaagatgagaaccgcatgctgagattggtggaatggagacttcagtgagcctacatgcagatgacatggtgacacccgtgcccagcctgagctgttt

SEQ ID NO: 125203 - DNA, 583 bp, Homo sapiens
  Payload ID: 4575
  Gene Symbol: DDX3X
  Gene Name: DEAD (Asp-Glu-Ala-Asp) box helicase 3, X-linked
  ENST ID: ENST00000631641
  CDS Start-End: 92-583
agagccgcagttctcccgtgagagggccttcgcggtggaacaaacactcgcttagcagcggaagactccgagttctcggtactcttcagggatgagtcatgtggcagtggaaaatgcgctcgggctggaccagcagtttgctggcctagacctgaactcttcagataatcagagtggaggaagtacagccagcagtttctacgataaagacagttcagggtggagttctagcaaagataaggatgcgtatagcagttttggatctcgtagtgattcaagagggaagtctagcttcttcagtgatcgtggaagtggatcaaggggaaggtttgatgatcgtggacggagtgattacgatggcattggcagccgtggtgacagaagtggctttggcaaatttgaacgtggtggaaacagtcgctggtgtgacaaatcagatgaagatgattggtcaaaaccactcccaccaagtgaacgcttggaacaggaactcttttctggaggcaacactgggattaattttgagaaatacgatgacattccagttgaggcaacaggcaacaactgtcctccacatattgaa

SEQ ID NO: 125204 - DNA, 4445 bp, Homo sapiens
  Payload ID: 4576
  Gene Symbol: DDX3Y
  Gene Name: DEAD (Asp-Glu-Ala-Asp) box helicase 3, Y-linked
  Uniprot ID: O15523
  ENST ID: ENST00000336079
  CDS Start-End: 107-2089
gcgtaggctaaccagtgcgcttaatagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaaccttggcacagaggtatgatacaactttaacaggagtcatcaattcatccataaatataaaaagggaaaaaaacttaaggcagtagtctgcattaggactgtttgagttttgcagacttggggttgggagaacatcttaaagcattaaagcatagttttttgtatggccaaccttactaaattaagttctgacttgctcactctatcctggataggcacttgggaacttacactctttaagccattccagtcatgatgaggtggaatgtatcagtataccaattaatatttttgaaagagctcttttaggttaatttaagtacagcaatttctcatgtaatgtttagggagtttattctaacctaggcaaacggcatgctatcacaagaaaggtttaaagctttgataaaatgggggagatttaatcagtttttttaatgcctgctataaaaatttgaaatattagaatggccgaccatggcagtgaccaggcctcactacaggcctggttggattctggtctttaatgcatgctagtgttgatgttttttggtcaagaacggtttaaacaggaaggattgtgcagcaggctttaatttaatgtagattcatactgctctgttaaagctgcattgaaatgttaaaatggcttacacttgcagactttgcaaatcttaagactaacaaatccttgaaatcacacagcttgcaaatacgtactaaactgcacaaggtgtgtgttctatatgtgcagttttagcgtattttagttgcataggtttccatggtatttatagtctcttgtgctaaatttggccaaagatgattgtccaccactaaaaatgcctctcccacttggaattctgtactgattttgtggccagatgcaatgatctttaaaaacaaatcttttcaatggcataagaagttgacaaaaatttcttaaagtgcaatagattttcaagtgtattgtgccttgttctaaaacttttaagtaggtgcacttgacagtattgaggtcatttgttaaggtgctatttcaattagtgtaggtttagactcttgtacatttctcccataactttttacaaagtattttgttgcacattcagagaattttatatatatatgtcttgtgtgggtgtcctcgaccttccaatcttatttcgtctcttggagattgttgaatgcagccagtgaagaagtagattcctaaattttattggggaccatggaatggtagttgagaagaaaactatttgcacacaacagattttagatactttttgctgctagttgtgtaatatttattgaacattttgacaaatatttatttttgtaagcctaaaaatgattctttgaaagtttaaagaaacttgaccaaaagacagtacaaaaaacactggcacttgaatgttgaatgtcaccgtatgtgaaataatatattttggggtagtgtgagcttttaatgttaagtctgttaaacttgagtcaaattaagcagacccggcattggcaatgtagctgtaattttctgacaaaatttaagacaaaattgtcaacttgaaactaaaacatgccaaggttttgatatacttgtcttaagatattaatgaaacacttctgaacactgataggaagtgtccacatccacaaagtttctcttgagttttgttatgtgttttgttgtgtttgattttcagtgattgtctggtatatttacagtcctcaaacatggttatttctgtcagtgacttaacattcggttttatcagccagcagtattcttcagtaaataaagaatggaattgctgaatgtaatcattgaacctcgagtcactgtaaaagttcagtaattgcttattgtattagttttagatgctggcactgcatgtgctctgtttattctgattttactaaaataaaaagttcaaaagtc

SEQ ID NO: 125205 - DNA, 2709 bp, Homo sapiens
  Payload ID: 4576
  Gene Symbol: DDX3Y
  Gene Name: DEAD (Asp-Glu-Ala-Asp) box helicase 3, Y-linked
  Uniprot ID: O15523
  ENST ID: ENST00000360160
  CDS Start-End: 310-2292
agaggggtctggagttcctaggtgaaccccagcagcctaaccctgtcaagtctgtcgagcctctggctggtcacacgtgctgcggaatccactcagctttcctcaggtgcagtcaggtccatcctgcagagggaccttctgcggacctgttctttcacctccctaacctgaagattgtattcaaaccaccgtggatcgctcacgtaaaatggtcactgcgcctaacacctgggatcccgtaacccttatctatcttggcttcagagagttttttgactagttccaactttgctgaagcttgtcaaagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaaggaaaatggaaggtatgggcgccgcaaacaatatccaatatccttggttttagccccaacaagagaattggctgtacagatctatgaggaagccagaaaattttcctaccgatctagagttcgtccttgtgtagtttatggtggtgctgatattggtcagcagattcgggacttagaacgtggatgccacttgttagtagccactccaggacgtctagtggatatgatggaaagaggaaagattggattagacttctgcaagtacttagtgttggatgaagctgataggatgctggatatgggatttgaacctcagatacgtcgtatagttgaacaagatactatgccaccaaagggcgttcgtcacaccatgatgtttagtgctacttttcctaaggaaatacagatgcttgctcgtgactttttggatgaatatatctttttggctgtaggcagagtaggctctacctctgagaacatcacacagaaagtagtttgggtggaagacttagataaacggtcatttctactggacattttaggtgcaacagggagtgattcacttactttagtgtttgtggagaccaaaaagggagcagattccctggaggatttcttataccatgaaggatatgcttgtactagtattcatggagaccggtcacagagagatcgagaggaggcccttcaccagtttcgctcaggaaaaagcccaattctagtggctacagctgtggcagcacgaggactagacatttcaaatgtgagacatgttatcaattttgatttgccaagtgatattgaagaatatgtgcatcgtattggccgtacaggacgtgtaggaaacctgggccttgccacctcattctttaatgaaaaaaatatgaatattacaaaggatttgttggatcttcttgtagaagctaaacaagaagtgccttcttggttggaaaatatggcttatgaacaccactacaagggtggcagtcgtggacgatctaaaagtaatagattcagtggaggatttggtgccagagactatcgacaaagtagtggttccagcagttctggctttggtgctagtcgcggaagcagcagccgcagtggtggaggtggttacggcaacagcagaggatttggtggaggtggctatggaggcttctacaatagtgatggatatggaggaaattataactcccagggggttgactggtggggcaactgaatctgctttgcagcaaagtcacccttacaaagaagctaatatggaaaccacatgtaacttagccagactatattgtgtagcttcaagaacttgcagtacattaccagctgtgattctcctgataattcaagggagctcaaagtcacaagaagaaaaatgaaaggaaaaaacagcagccctattcagaaattggtttgaagatgtaattgctctagtttggattaaactcttcccctcctgctttagtgccaccccaaactgcatttataattttgtgactgaggatcgtttgtttgttaacgtactgtgactttaactttagacaacttactactttgatgtcctgttggctcagtaatgctcacgataccaattgttttgacaaaataaatttactaaacttggcctaaaatcaaa

SEQ ID NO: 125206 - DNA, 1049 bp, Homo sapiens
  Payload ID: 4576
  Gene Symbol: DDX3Y
  Gene Name: DEAD (Asp-Glu-Ala-Asp) box helicase 3, Y-linked
  ENST ID: ENST00000454054
  CDS Start-End: 377-1049
ggagttcctaggtgaaccccagcagcctaaccctgtcaagtctgtcgagcctctggctggtcacacgtgctgcggaatccactcagctttcctcaggtgcagtcaggtccatcctgcagagggaccttctgcggacctgttctttcacctccctaacctgaagattgtattcaaaccaccgtggatcgctcacgtaaaatggtcactgcgcctaacacctgggatcccgtaacccttatctatcttggcttcagagagttttttgactagttccaactttgctgaagcttgtcaaagctgtaggtccagtgtaagagttccgctattcggtctcacacctacagtggactacccgatttttcgcttctcttcagggatgagtcatgtggtggtgaaaaatgaccctgaactggaccagcagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacag

SEQ ID NO: 125207 - DNA, 792 bp, Homo sapiens
  Payload ID: 4576
  Gene Symbol: DDX3Y
  Gene Name: DEAD (Asp-Glu-Ala-Asp) box helicase 3, Y-linked
  ENST ID: ENST00000440554
  CDS Start-End: 43-792
gaaggatggctgccgcgtgcttctcttgaccctgtagaaataatggaaattggacgcccgcggaaagacacctggaagcttgctaatctggacctgaactctgaaaaacagagtggaggagcaagtacagcgagcaaagggcgctatatacctcctcacttaaggaacagagaagcatctaaaggattccatgataaagacagttcaggttggagttgcagcaaagataaggatgcatatagcagttttgggtctcgagattctagaggaaagcctggttatttcagtgaacgtggaagtggatcaaggggaagatttgatgatcgtggacggagtgactatgatggtattggcaatcgtgaaagacctggctttggcagatttgaacggagtggacatagtcgttggtgtgacaagtcagttgaagatgattggtcaaaaccacttccaccaagtgaacgcttggagcaagaactgttttctggaggaaacacggggattaactttgagaaatatgatgatataccagtagaggcaaccggcagtaactgtcctccacatattgagaattttagcgatattgacatgggagaaattatcatggggaacattgaacttactcgctatactcgtcctactccagtgcaaaaacatgccattcctattattaagggaaaaagagacttaatggcttgtgcccaaacaggatctgggaaaactgcagcatttcttttacccatactgagtcagatatatacagatggtccaggagaagctttgaaggctgtgaag

SEQ ID NO: 125208 - DNA, 2783 bp, Homo sapiens
  Payload ID: 4577
  Gene Symbol: DDX42
  Gene Name: DEAD (Asp-Glu-Ala-Asp) box helicase 42
  Uniprot ID: Q86XP3
  ENST ID: ENST00000359353
  CDS Start-End: 324-2783
aacgggccgtgaggcggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcagctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttag

SEQ ID NO: 125209 - DNA, 3939 bp, Homo sapiens
  Payload ID: 4577
  Gene Symbol: DDX42
  Gene Name: DEAD (Asp-Glu-Ala-Asp) box helicase 42
  Uniprot ID: Q86XP3
  ENST ID: ENST00000389924
  CDS Start-End: 205-3021
caacgggccgtgaggcggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccggg

SEQ ID NO: 125210 - DNA, 3323 bp, Homo sapiens
  Payload ID: 4577
  Gene Symbol: DDX42
  Gene Name: DEAD (Asp-Glu-Ala-Asp) box helicase 42
  ENST ID: ENST00000457800
  CDS Start-End: 18-2144
atcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtg

SEQ ID NO: 125211 - DNA, 1427 bp, Homo sapiens
  Payload ID: 4577
  Gene Symbol: DDX42
  Gene Name: DEAD (Asp-Glu-Ala-Asp) box helicase 42
  ENST ID: ENST00000577940
  CDS Start-End: 1-298
tgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagactaactttgaataattggacctgcagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattg

SEQ ID NO: 125212 - DNA, 510 bp, Homo sapiens
  Payload ID: 4577
  Gene Symbol: DDX42
  Gene Name: DEAD (Asp-Glu-Ala-Asp) box helicase 42
  ENST ID: ENST00000584261
  CDS Start-End: 1-212
gccagcaattccattccaagccagtagattctgacagcgatgatgatcccttggaggcattcatggctgaagtggaggatcaggcagctagagacatgaagaggcttgaagaaaaggacaaggaaagaaaaaacgtaaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtg

SEQ ID NO: 125213 - DNA, 857 bp, Homo sapiens
  Payload ID: 4577
  Gene Symbol: DDX42
  Gene Name: DEAD (Asp-Glu-Ala-Asp) box helicase 42
  ENST ID: ENST00000578137
  CDS Start-End: 13-492
gtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaatgttgagagttcctgtgctgtgtggaattcaacactaatctgctgaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtaagcatcattaagctcaatattcttaatattaatgttaattagtccagatttagtattattggttatctaaactaataaccttgaatttcttttctaatggtctctgaac

SEQ ID NO: 125214 - DNA, 4148 bp, Homo sapiens
  Payload ID: 4577
  Gene Symbol: DDX42
  Gene Name: DEAD (Asp-Glu-Ala-Asp) box helicase 42
  Uniprot ID: Q86XP3
  ENST ID: ENST00000583590
  CDS Start-End: 413-3229
atatgcaacagtttaaactataggcatgttcatgtaaatatggtttctgtccaacccgttttctcttgggatttttggctagccccttgacgccactttttcttcattcgcagacccactttctagatgggtcatgaacactgtccacccaactgcagtttcccgtcagagtatctgaggagcctgtgaggcgttctggagctttaagcaacgggccgtgaggcggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccggga

SEQ ID NO: 125215 - DNA, 4337 bp, Homo sapiens
  Payload ID: 4577
  Gene Symbol: DDX42
  Gene Name: DEAD (Asp-Glu-Ala-Asp) box helicase 42
  Uniprot ID: Q86XP3
  ENST ID: ENST00000578681
  CDS Start-End: 602-3418
caagagtgtcgctctagtagtatatgcaacagtttaaactataggcatgttcatgtaaatatggtttctgtccaacccgttttctcttgggatttttggctagccccttgacgccactttttcttcattcgcagacccactttctagatgggtcatgaacactgtccacccaactgcagtttcccgtcagagtatctgaggagcctgtgaggcgttctggagctttaaggtcaggcgccttccgggagccgtagccccggccccgcccttctgcccgcgcgttcctcactgcgcatgtcgcgtttttgttcccctccccccttcagcaacgggccgtgaggcggtggcggtggtggcggtggcggcggcggtggtggtggtggcggcggcggcggcgaagggggcggagaggaaggagcgcggcgggaccgggccgggacagcgcgtactttgggctccgggattcgctccgcgcccgcggttgtagcagctgccgctgcagccatagcagcaggacttcctcaagcgcagggactatgtcttaaggcgctttgcagagccaagctcatttctggcacataagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaagccagtagattctgacagcgatgatgatcccttggaggcattcatggctgaagtggaggatcaggcagctagagacatgaagaggcttgaagaaaaggacaaggaaagaaaaaacgtaaagggtattcgagatgacattgaagaggaagatgaccaagaagcttattttcgatacatggcagaaaacccaactgctggtgtggttcaggaggaagaggaagacaatctagaatatgatagtgacggaaatccaattgcacctaccaaaaaaatcattgatcctcttccccccattgatcattcagagattgactatccaccatttgaaaaaaacttttacaatgagcatgaagagataaccaacctcactccacagcagttaatagatctccggcataagctcaatcttcgggtctctggtgctgcacctcctagaccaggaagtagctttgctcattttgggtttgacgaacaacttatgcaccagattcggaaatctgaatacacacagcccactccaatacagtgccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcagatccatgcagaatgtaagcggtttggaaaagcatataatcttcgatcagtggccgtatatggaggagggagtatgtgggagcaggccaaggcccttcaggagggggcagagattgttgtgtgtaccccaggtcgactgatagatcatgtgaaaaagaaagctaccaatcttcaaagagtctcttaccttgtgtttgatgaagcagatcgaatgtttgacatgggatttgagtaccaagttcgatccatagcaagtcatgttcgtcctgacaggcagactctcttatttagtgcaacttttcggaagaagattgaaaagttggccagagacatcctgatcgaccctattcgagtggtgcagggagatattggagaggcaaatgaagatgtgacacagattgtggagattctccattctggacctagtaaatggaactggcttacccggcgtctggtagaatttacctcttcagggagtgtcctcctctttgttactaaaaaagccaatgctgaagagctagcgaataaccttaaacaggagggtcataatcttgggctgctccatggggatatggatcagagtgagagaaacaaggtcatttcagactttaagaaaaaggacatcccagtcctggtggccacagatgttgcagcccgtggtctggacattccttcaattaagactgtcattaactatgatgtggcacgagacattgatacccacacgcataggattggccgcacaggaagagcgggtgagaaaggtgtggcctataccctactcactcccaaggacagcaattttgctggtgacctggtccggaacttggaaggagccaatcaacacgtttctaaggaactcctagatctggcaatgcagaatgcctggtttcggaaatctcgattcaaaggagggaaaggaaaaaagctgaacattggtggaggaggcctaggctacagggagcggcctggcctgggctctgagaacatggatcgaggaaataacaatgtaatgagcaattatgaggcctacaagccttccacaggagctatgggagatcgactaacggcaatgaaagcagctttccagtcacagtacaagagtcactttgttgcagccagtttaagtaatcagaaggctggaagttctgctgctggggcaagtgggtggactagtgcagggagcttgaattctgttccaactaactcagcacaacagggccataacagtcctgacagccccgtcaccagtgccgccaagggcatcccaggctttggcaatactggcaacatcagtggtgcccctgtgacctacccgtctgccggagcccaaggagtcaacaacacagcttcagggaataacagccgagaagggactgggggcagcaacgggaaaagagagagatatactgagaaccggggcagcagccgtcacagtcacggagagactggcaatcggcatagcgatagtccacgtcacggagatggtggtcgccatggagatggataccgccatccagaaagcagcagccgtcatactgatggccatcggcacggggagaacagacatggaggaagcgcaggccggcatggggagaaccggggtgcaaatgatggtcggaatggggaaagcaggaaagaagcttttaatcgtgagagcaagatggagcccaagatggaacccaaagtggacagcagcaagatggacaaggtggacagcaagacagataagacagctgacggctttgctgtcccagagccgcctaaacgcaagaaaagtcgatgggacagttagaggggatgtgctaaagcgtgaaatcagttgtccttaatttttagaaagattttggtaactaggtgtctcagggctgggttggggtccaaagtgtaaggaccccctgcccttagtggagagctggagcttggagacattaccccttcatcagaaggaattttcggatgttttcttgggaagctgttttggtccttggaagcagtgagagctgggaagcttcttttggctctaggtgagttgtcatgtgggtaagttgaggttatcttgggataaagggtcttctagggcacaaaactcactctaggtttatattgtatgtagcttatattttttactaaggtgtcaccttataagcatctataaattgacttctttttcttagttgtatggccaggcagtccccattttaggagttggcttctgcaaattcaatccattgagctaactgttggggagcaatttggtagttgtagacatttgcagggaagggagatgtctgattctaaatgggagttgatgctcaggtccccagccaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaacccaacaacagcttttaaagtgtcttctatctcattgtattttttttaacttgccccaatgatagaaaagtcttttgctgaaatgattttgatgatttttgtttatcgtttataaaaaggaaaagaaatatacaaactttgacttttgtgactttgtgaaggtttctttaagatgtgcattcctttctgcttgctctctagtaaatgttttactaccggga

SEQ ID NO: 125216 - DNA, 589 bp, Homo sapiens
  Payload ID: 4577
  Gene Symbol: DDX42
  Gene Name: DEAD (Asp-Glu-Ala-Asp) box helicase 42
  ENST ID: ENST00000581135
  CDS Start-End: 276-589
atgcgagcggctcgtcagcgcctgcgcgcagcctgcggggcgggacgcaaccccggggaaagcgcgagacctccctctctcccgcccggctgaggcgaggtggggcttttgggaaaattacataatccccgcccctgggccggaactgccctcgcctatcccaatcctcctacctaggattccgtcaagttgacgtcacacggaaccggtgctccggaagctaaaggtggccatgctgtgtgggaccacgtggccagaggtcagtcattggcaccatgaactggaataaaggtggtcctggcactaagcgaggatttggctttggaggttttgccatcagtgctgggaaaaaggaggaacccaaactcccacagcagtcccacagtgcctttggggcaaccagctcttcttctggatttggaaagtcagctccaccacagcttccttctttctacaaaattggatctaagcgggccaactttgatgaagaaaatgcctattttgaagatgaggaagaagattctagcaacgttgatttaccttacattcctgctgaaaactcaccaactcgccagcaattccattccaa

SEQ ID NO: 125217 - DNA, 2554 bp, Homo sapiens
  Payload ID: 4578
  Gene Symbol: DDX5
  Gene Name: DEAD (Asp-Glu-Ala-Asp) box helicase 5
  Uniprot ID: P17844
  ENST ID: ENST00000225792
  CDS Start-End: 403-2247
agaagaaggtgaggtcaagagagtgcagaatgaggcattccaatggtgggtgggccctgacctgagagagtggcgcggggaggggtgaaagcgcggcgatcctggaacgccagcgggcgttgcggcctatgcgcgaggggcggggcgattaggtcatagagcggctcccagcgttccctgcggcgtaggaggcggtccagactataaaagcggctgccggaaagcggccggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaa

SEQ ID NO: 125218 - DNA, 2077 bp, Homo sapiens
  Payload ID: 4578
  Gene Symbol: DDX5
  Gene Name: DEAD (Asp-Glu-Ala-Asp) box helicase 5
  Uniprot ID: P17844
  ENST ID: ENST00000450599
  CDS Start-End: 169-1776
ctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactg

SEQ ID NO: 125219 - DNA, 2225 bp, Homo sapiens
  Payload ID: 4578
  Gene Symbol: DDX5
  Gene Name: DEAD (Asp-Glu-Ala-Asp) box helicase 5
  ENST ID: ENST00000540698
  CDS Start-End: 171-461
acctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaa

SEQ ID NO: 125220 - DNA, 676 bp, Homo sapiens
  Payload ID: 4578
  Gene Symbol: DDX5
  Gene Name: DEAD (Asp-Glu-Ala-Asp) box helicase 5
  ENST ID: ENST00000584279
  CDS Start-End: 317-676
ggtccggggtggtacagccacgtgacaacgccaggccccgccttccccctcttttggttacagacgtgagggctctttggagacgtaaacatctccgagtggcgagggtgggcggggctgggcttgggaaagggcggggtggcttgcttgaggtgtggaaagaccagaagaagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctatt

SEQ ID NO: 125221 - DNA, 838 bp, Homo sapiens
  Payload ID: 4578
  Gene Symbol: DDX5
  Gene Name: DEAD (Asp-Glu-Ala-Asp) box helicase 5
  ENST ID: ENST00000577787
  CDS Start-End: 1-501
gagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaagtaagttttattaactctgttatatttgcttcctaacaactttgctgtaaaattgagggatcattgtttggtgagttgttttaggttatttcagttggtgtgatttcatttagttagcctactaatcctgaaaatttcttgaatccttcaaataatggctgtcaccatttatagctttcctatagaaggaattcatgtgtcccctggttgacttaaggaccaagggtcgaactgctcgataagtggattagcaggcgtttcctctttgacttccagccatgtaaattgaacttaatgttttgctgaccataaatgtgtggccctagcaatggtcttttaaa

SEQ ID NO: 125222 - DNA, 2021 bp, Homo sapiens
  Payload ID: 4578
  Gene Symbol: DDX5
  Gene Name: DEAD (Asp-Glu-Ala-Asp) box helicase 5
  ENST ID: ENST00000578804
  CDS Start-End: 168-2012
tcctttcccgaaggcttgcgccattttgatattcacgtcacagtgattggaagagatttgacggtgtagtgtcttcaagcttgctttttgtgtggggattggggagctgtcggggcggctgccatttggtagctgttgagggagttgagagggagcgtattgtgcggatgaaagcgggacgcttcgaggcagacgaaggaacatctgttaggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttaga

SEQ ID NO: 125223 - DNA, 474 bp, Homo sapiens
  Payload ID: 4578
  Gene Symbol: DDX5
  Gene Name: DEAD (Asp-Glu-Ala-Asp) box helicase 5
  ENST ID: ENST00000583239
  CDS Start-End: 361-474
gcagagagaaatgcgagacaaagggggaagcgccgccccagcgggaacgccgcccggccgactccgcccgggccgggactcctcccccggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctggg

SEQ ID NO: 125224 - DNA, 1051 bp, Homo sapiens
  Payload ID: 4578
  Gene Symbol: DDX5
  Gene Name: DEAD (Asp-Glu-Ala-Asp) box helicase 5
  ENST ID: ENST00000585111
  CDS Start-End: 920-1051
gggcataataaatcttaagaatgctgttcctttaaagaccaatacaaaagcaggtacgacctcagggcccatagtgcaagggcggagggcacacggacagcggctagacgccccacagaaagacaagtccggggacgacccttctgaccgctctttttacagccaggacccaagtgtcctaccggcctcgccccagtgcctctctctctcccacagcatactgctgttccacggcctcgaagcgaagaggtggtgaagctgagagaccctatccagggaacccgccagcgcgacgcggcgtctgaaggtcacgagccccgccgacagcccagacccagtccgggctagcccgaggcctccctggaggtggacggtttcagtccacacatactgggaccccagggagacactcaccagcatccgagcctgccatgtttcagaggcaggtcgccgccggactccgacgcggccgggaaggcgacggtgtcctggaaggaccgatccacgcagacccgacactggggcgcggacgcacgaaccaaagcgcggggaaggaggcgtgaaagaaggacggacgttaaaagagcttctcgccgctgattggtcatcagaggagcacttcctttcacaggacgtgaaacgggggcggtttgggaagtttagagaccattctccgccgaccaaaacccgtcaaaggattatcagacacgcgggtcggacggtccacatcagccggcagcccgggcgggtcccggggtgcgagcagcgcacttccgtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaag

SEQ ID NO: 125225 - DNA, 582 bp, Homo sapiens
  Payload ID: 4578
  Gene Symbol: DDX5
  Gene Name: DEAD (Asp-Glu-Ala-Asp) box helicase 5
  ENST ID: ENST00000578190
  CDS Start-End: 444-582
attcgttgatccggagctctaccgcggcgttcccccagctgggtttgctagcagaagtgtttctgagaaaacccttgttctgttatcgctgactgtactgtttaggttcttaccactaaagctgtttggttccaaaacggccatatgagtaacatcgtcgtgatgctcttcggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctg

SEQ ID NO: 125226 - DNA, 543 bp, Homo sapiens
  Payload ID: 4578
  Gene Symbol: DDX5
  Gene Name: DEAD (Asp-Glu-Ala-Asp) box helicase 5
  ENST ID: ENST00000583212
  CDS Start-End: 513-543
ttaccactaaagctgtttggttccaaaacggccatatgagtaacatcgtcgtgatgctcttcggttcatgtagccttgttattgctgatagtgaattgctaggctggtggggaagattacagtaaccacaagaagtggtgtgtgccagaatcccaaattctggcatgtgggtgacaagtttccgacatgataaatccccggcttccgacatgataaatcccaggctgtttacatgacctaagtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactg

SEQ ID NO: 125227 - DNA, 575 bp, Homo sapiens
  Payload ID: 4578
  Gene Symbol: DDX5
  Gene Name: DEAD (Asp-Glu-Ala-Asp) box helicase 5
  ENST ID: ENST00000578400
  CDS Start-End: 205-504
agactataaaagcggctgccggaaagcggccggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagagtgtggaaaaaccaatctgagaagaacaacctaccttgtccttgatgaagcagatagaatgcttgatatgggctttgaaccccaaataaggaagattgtggatcaaataagacctg

SEQ ID NO: 125228 - DNA, 576 bp, Homo sapiens
  Payload ID: 4578
  Gene Symbol: DDX5
  Gene Name: DEAD (Asp-Glu-Ala-Asp) box helicase 5
  ENST ID: ENST00000581806
  CDS Start-End: 421-576
acaggacgtgaaacgggggcggtttgggaagtttagagaccattctccgccgaccaaaacccgtcaaaggattatcagacacgcgggtcggacggtccacatcagccggcagcccgggcgggtcccggggtgcgagcagcgcacttccggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaat

SEQ ID NO: 125229 - DNA, 580 bp, Homo sapiens
  Payload ID: 4578
  Gene Symbol: DDX5
  Gene Name: DEAD (Asp-Glu-Ala-Asp) box helicase 5
  ENST ID: ENST00000581697
  CDS Start-End: 385-580
cagacgtgagggctctttggagacgtaaacatctccgagtggcgagggtgggcggggctgggcttgggaaagggcggggtggcttgcttgaggtgtggaaagaccagaagaaggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtt

SEQ ID NO: 125230 - DNA, 996 bp, Homo sapiens
  Payload ID: 4578
  Gene Symbol: DDX5
  Gene Name: DEAD (Asp-Glu-Ala-Asp) box helicase 5
  ENST ID: ENST00000577922
  CDS Start-End: 359-996
ctccgccgacgtcaacgggaaagtagtgcggaccgctctctcggtggtccggggtggtacagccacgtgacaacgccaggccccgccttccccctcttttggttacagacgtgagggctctttggagacgtaaacatctccgagtggcgagggtgggcggggctgggcttgggaaagggcggggtggcttgcttgaggtgtggaaagaccagaagaagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtga

SEQ ID NO: 125231 - DNA, 2156 bp, Homo sapiens
  Payload ID: 4578
  Gene Symbol: DDX5
  Gene Name: DEAD (Asp-Glu-Ala-Asp) box helicase 5
  ENST ID: ENST00000581693
  CDS Start-End: 171-287
acctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgaggcaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggagtggcacagactggatctgggaaaacattgtcttatttgcttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcacagcatacactttctttacacctaataacataaagcaagtgagcgaccttatctctgtgcttcgtgaagctaatcaagcaattaatcccaagttgcttcagttggtcgaagacagaggttcaggtcgttccaggggtagaggaggcatgaaggatgaccgtcgggacagatactctgcgggcaaaaggggtggatttaatacctttagagacagggaaaattatgacagaggttactctagcctgcttaaaagagattttggggcaaaaactcagaatggtgtttacagtgctgcaaattacaccaatgggagctttggaagtaattttgtgtctgctggtatacagaccagttttaggactggtaatccaacagggacttaccagaatggttatgatagcactcagcaatacggaagtaatgttccaaatatgcacaatggtatgaaccaacaggcatatgcatatcctgctactgcagctgcacctatgattggttatccaatgccaacaggatattcccaataagactttagaagtatatgtaaatgtctgtttttcataattgctctttatattgtgtgttatctgacaagatagttatttaagaaacatgggaattgcagaaatgactgcagtgcagcagtaattatggtgcactttttcgctatttaagttggatatttctctacattcctgaaacaatttttaggttttttttgtactagaaaatgcaggcagtgttttcacaaaagtaaatgtacagtgatttgaaatacaataaatgaaggcaatgcatggccttccaataaaaaatatttgaagactgaattaa

SEQ ID NO: 125232 - DNA, 531 bp, Homo sapiens
  Payload ID: 4578
  Gene Symbol: DDX5
  Gene Name: DEAD (Asp-Glu-Ala-Asp) box helicase 5
  ENST ID: ENST00000579091
  CDS Start-End: 438-531
gactcctcccccggtagtcgccggctcctccttttcttttttcctgcgttatataattttgattcgttgatccggagctctaccgcggcgttcccccagctgggtttgctagcagaagtgtttctgagaaaacccttgttctgttatcgctgactgtactgtttaggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaagctcagggatggccagttgctctaagtggattggatatggttggag

SEQ ID NO: 125233 - DNA, 820 bp, Homo sapiens
  Payload ID: 4578
  Gene Symbol: DDX5
  Gene Name: DEAD (Asp-Glu-Ala-Asp) box helicase 5
  ENST ID: ENST00000579996
  CDS Start-End: 1-461
agagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagaaaaggatgaaaaacttattcgtctaatggaagagatcatgagtgagaaggagaataaaaccattgtttttgtggaaaccaaaagaagatgtgatgagcttaccagaaaaatgaggagagatgggtatgtgtgagctcctccattgaagcagattgattaaaacagcttaggaaagggcaaacttggatcacgagcagtggatttttttcatatctgatagtgaatttaactttttcatttctggcgaaattaaagagatctgtgaccaaaagtggtcaagcactggagtctgaggttttcaatgtgagtttaataacacaacttgtcttttaacttaggtggcctgccatgggtatccatggtgacaagagtcaacaagagcgtgactgggttctaaatggtaaatatttcaaatgaagtatttttcccccttacttaacctagctagaattctgctcagataattgatcatgtatatgccttcctttgtag

SEQ ID NO: 125234 - DNA, 572 bp, Homo sapiens
  Payload ID: 4578
  Gene Symbol: DDX5
  Gene Name: DEAD (Asp-Glu-Ala-Asp) box helicase 5
  ENST ID: ENST00000585060
  CDS Start-End: 524-572
acctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgaggccatttgaaaatgtgaataacgttttttttcattccaggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagccagttctaaatttttatgaagccaatttccctgcaaatgtcatggatgttattgcaagacagaatttcactgaacccactgctattcaag

SEQ ID NO: 125235 - DNA, 473 bp, Homo sapiens
  Payload ID: 4578
  Gene Symbol: DDX5
  Gene Name: DEAD (Asp-Glu-Ala-Asp) box helicase 5
  ENST ID: ENST00000630471
  CDS Start-End: 174-473
ggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgccatgtcgggttattcgagtgaccgagaccgcggccgggaccgagggtttggtgcacctcgatttggaggaagtagggcagggcccttatctggaaagaagtttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagagtgtggaaaaaccaatctgagaagaacaacctaccttgtccttga

SEQ ID NO: 125236 - DNA, 2336 bp, Homo sapiens
  Payload ID: 4579
  Gene Symbol: DDX56
  Gene Name: DEAD (Asp-Glu-Ala-Asp) box helicase 56
  Uniprot ID: Q9NY93
  ENST ID: ENST00000258772
  CDS Start-End: 108-1751
ccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgccccagtttgtgcctccagcatatgaaaaggactatttgaatccccaaaacatcaggagtcgggaaacttcggaagacagctgtgcctggctctgtggctgcatgcagtgcttcacttggccagcagaggtcagctgtgccgagctgccccagccatgagaagagaagcctgcccttgctggcaggtggctatggccggcccagagccttcctgcccagctcctgcagccctgctgcctgggatcaggctgggagatgggccttcctgaccgccagccttcctctccccgagcacacgcacatgtagattcggggggaagctgcctgctcttccttagaggagccggggcagctatctgctggtccctttctgaacaactgttgatgtgtga

SEQ ID NO: 125237 - DNA, 1287 bp, Homo sapiens
  Payload ID: 4579
  Gene Symbol: DDX56
  Gene Name: DEAD (Asp-Glu-Ala-Asp) box helicase 56
  ENST ID: ENST00000415758
  CDS Start-End: 14-325
actgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggtagtagtgtgacggcccaggcatctgcatggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcaggtgtccacccccaggatgccatgcgctcagtgactaagcaggccattcgggaggcaagattgaaggagatcaaggaagagcttctgcattctgagaagcttaagacatactt

SEQ ID NO: 125238 - DNA, 691 bp, Homo sapiens
  Payload ID: 4579
  Gene Symbol: DDX56
  Gene Name: DEAD (Asp-Glu-Ala-Asp) box helicase 56
  ENST ID: ENST00000448192
  CDS Start-End: 1-549
cacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaaggccaaggtacggctcctggggactgcggacagccccaggactcctcccaacctgctcttttgtcatcaccagaatgtggaggcgccttgccctagggaggggaagagagggtgccctagggaggggaagagggggcaccctagaaccgggccccaaaaatctggtgtgggataggggtacttttgcagccgcctgcaggccctgcttttctttccccagctgcctttccccatttccttatctgcagcaccttctggtcgtgttggccagttgccggcacggctccctttgtgtctttctcagttgggtgggtggg

SEQ ID NO: 125239 - DNA, 3028 bp, Homo sapiens
  Payload ID: 4579
  Gene Symbol: DDX56
  Gene Name: DEAD (Asp-Glu-Ala-Asp) box helicase 56
  ENST ID: ENST00000421223
  CDS Start-End: 1157-2284
ttgccttttccagcttggctctggctcccttcctccagcaagggtgggttgagctctcacatggcaccactttgacctcttctgcttccctcttctacactgaaagacttatgggccaggagcagtggctcgcacctgcaatcccagcactttgggaggccgaggaaggcagatcgcttggccccaggagttcaaaaccgtcctgggcaacgtggcgaaaccccatctagaaagaaaagaagagaaggggaggggggaggggaggaggagttacatatatacacatacacacacacacacacgtacgtacatacatacatacacgctaactggacgtggtggtgcgtgcctgtagtcttagctttccaggagactgaggtgggaggaccacttgagcctgagatcgcgccagcctgggtgacagtcagaccatgtctcaaaaaaaaaaaaagatttgtgattaggattcttagtcctcacctgtattattttcctattgctactgtaacaaattaccacaaatttactggcttaaaacgacgcaagtctgtaggtcagaagtctgacacgggtcttaactggtgacccgagtcagatttgggacacaaagaacagaaaccaagctgtgcaggtttctgacaggcagtccggttagggagccctacagcaacccgccggtcctctctctcaggcagttgctgccatggctcattattccaaccggttctcctcagcccagtctatctcagtggctccattcatagggtgatgtgcccggcgggacactaaccctaaccaagcagagagacggtcatgcccgtcacgacctcggccctcgccccggccgaggcttctcctgcaggtcgcgagaatcaggtgcgtcagcggcgtccgggaacgccggaagagccagtggagcggctctgtagtccaaagtaccccgtcgaccccagcacggccgctccaccgcctcctactagacccagtcctagggactgcgcagtcgcagagctccgtccgagtaccggaagcctaggccgccagcacttccgggaagtgacttcgtctccgaagccgattggttgttgctttgctcccgctcgcgtcggtggcgtttttcctgcagcgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggtagtagtgtgacggcccaggcatctgcatggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccc

SEQ ID NO: 125240 - DNA, 1554 bp, Homo sapiens
  Payload ID: 4579
  Gene Symbol: DDX56
  Gene Name: DEAD (Asp-Glu-Ala-Asp) box helicase 56
  Uniprot ID: Q9NY93
  ENST ID: ENST00000431640
  CDS Start-End: 31-1554
cgcgtgcgtgctgcgctactgagcagcgccatggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccagggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaaggccaagagagcaaagtcccagaacccactgcgcagcttcaagcacaaaggaaagaaattcagacccacagccaagccctcctga

SEQ ID NO: 125241 - DNA, 1853 bp, Homo sapiens
  Payload ID: 4579
  Gene Symbol: DDX56
  Gene Name: DEAD (Asp-Glu-Ala-Asp) box helicase 56
  ENST ID: ENST00000446987
  CDS Start-End: 1-558
atggaggactctgaagcactgggcttcgaacacatgggcctcgatccccggctccttcaggctgtcaccgatctgggctggtcgcgacctacgctgatccaggagaaggccatcccactggccctagaagggaaggacctcctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctggtaaggcagagtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcagggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccccttgacaacagaataaaaattttagctgcccca

SEQ ID NO: 125242 - DNA, 1682 bp, Homo sapiens
  Payload ID: 4579
  Gene Symbol: DDX56
  Gene Name: DEAD (Asp-Glu-Ala-Asp) box helicase 56
  ENST ID: ENST00000433257
  CDS Start-End: 1-1189
cctggctcgggcccgcacgggctccgggaagacggccgcttatgctattccgatgctgcagctgttgctccataggaaggcgacaggtccggtggtagaacaggcagtgagaggccttgttcttgttcctaccaaggagctggcacggcaagcacagtccatgattcagcagctggctacctactgtgctcgggatgtccgagtggccaatgtctcagctgctgaagactcagtctctcagagagctgtgctgatggagaagccagatgtggtagtagggaccccatctcgcatattaagccacttgcagcaagacagcctgaaacttcgtgactccctggagcttttggtggtggacgaagctgaccttcttttttcctttggctttgaagaagagctcaagagtctcctctgtcacttgccccggatttaccaggcttttctcatgtcagctacttttaacgaggacgtacaagcactcaaggagctgatattacataacccggttacccttaagttacaggagtcccagctgcctgggccagaccagttacagcagtttcaggtggtctgtgagactgaggaagacaaattcctcctgctgtatgccctgctcaagctgtcattgattcggggcaagtctctgctctttgtcaacactctagaacggagttaccggctacgcctgttcttggaacagttcagcatccccacctgtgtgctcaatggagagcttccactgcgctccaggtgccacatcatctcacagttcaaccaaggcttctacgactgtgtcatagcaactgatgctgaagtcctgggggccccagtcaagggcaagcgtcggggccgagggcccaaaggggacaaggcctctgatccggaagcaggtgtggcccggggcatagacttccaccatgtgtctgctgtgctcaactttgatcttcccccaacccctgaggcctacatccatcgagctggcaggacagcacgcgctaacaacccaggcatagtcttaacctttgtgcttcccacggagcagttccacttaggcaagattgaggagcttctcagtggagagaacaggggccccattctgctcccctaccagttccggatggaggagatcgagggcttccgctatcgctgcaggtgtccacccccaggatgccatgcgctcagtgactaagcaggccattcgggaggcaagattgaaggagatcaaggaagagcttctgcattctgagaagcttaagacatactttgaagacaaccctagggacctccagctgctgcggcatgacctacctttgcaccccgcagtggtgaagccccacctgggccatgttcctgactacctggttcctcctgctctccgtggcctggtgcgccctcacaagaagcggaagaagctgtcttcctcttgtaggaaggccaagagagcaaagtcccagaacccactgcgcagcttcaagcacaaaggaaagaaattcagacccacagccaagccctcctgaggttgttgggcctctctggagctgagcacattgtggagcacaggcttacacccttcgtggacaggcgaggctctggtgcttactgcacagcctgaacagacagttctggggccggcagtgctgggccctttagctccttggcacttccaagctggcatcttgccc

SEQ ID NO: 125243 - DNA, 1936 bp, Homo sapiens
  Payload ID: 4580
  Gene Symbol: DDX6
  Gene Name: DEAD (Asp-Glu-Ala-Asp) box helicase 6
  Uniprot ID: P26196
  ENST ID: ENST00000526070
  CDS Start-End: 362-1813
attttgggagcttcgagtcaacaataaaggaccgagggtgccgagcgggagtggcctcgttggtaggacacgggcccgagtcgcgaggcttgggattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgtacgtccctgacagaacagctaagaggaacctttaaatgagggaaatcaaaatcttctttcctgggggaaatttgatgtcacaccatatataatagcaataaagggtaaaatacc

SEQ ID NO: 125244 - DNA, 4538 bp, Homo sapiens
  Payload ID: 4580
  Gene Symbol: DDX6
  Gene Name: DEAD (Asp-Glu-Ala-Asp) box helicase 6
  Uniprot ID: P26196
  ENST ID: ENST00000534980
  CDS Start-End: 307-1758
gcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcctctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtcttcttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataactttgtaaataagttttttttctgggttcatatatatatatatatatacatatatatatatttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaacatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgaggactaggtcaaagcctggtctttttttttttttttttttttttctttcttttttgggccctcataataagcattgtt

SEQ ID NO: 125245 - DNA, 6152 bp, Homo sapiens
  Payload ID: 4580
  Gene Symbol: DDX6
  Gene Name: DEAD (Asp-Glu-Ala-Asp) box helicase 6
  Uniprot ID: P26196
  ENST ID: ENST00000620157
  CDS Start-End: 362-1813
attttgggagcttcgagtcaacaataaaggaccgagggtgccgagcgggagtggcctcgttggtaggacacgggcccgagtcgcgaggcttgggattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcctctctttgtgggtttttcatcttttattttggaactatgaagacttaaaagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtcttcttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataactttgtaaataagttttttttctgggttcatatatatatatatatatacatatatatatatttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaacatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgaggactaggtcaaagcctggtctttttttttttttttttttttttctttcttttttgggccctcataataagcattgttactattggaagttgttttcacattctttccaatattaaatatgtatttttttaagtaatgataatattttccagtggctcatttggatgagaactaccctctatttttaatattaaaactacatccaactcatcatttagcctttggttgtacagttgtgtaatgggctatggactgttacacaccttaccacctctaggcctatgttttttctttccccatatattctgatggggataaatactgttttgcctctcccataggaatggaatacatttattctaaaatgatctttcacagaagtaagagagagggaaacctaaatatacctctaaattgtttgaagttggtcccagcagcataaaatgggttggccccaaagggttggagggtgggcttggttatcagtatttgttttcagaatgagatgggagcatctttcctttgccacgtgctttgtgcttgataacatcatgcttggttcaaacgacaactcagcacaaagccttgagtataaattgttggaatcaaaacatctcattctgatgacgtggtttaattttttaatttttttttttaataggggtgggagggagggtactttgccccagaagggagggtgtctgcactaaggatttagaaacactttggaagctcataacctcatcagaaactgcctttagccacactcctgaccttctagatgagtaacaaaaaaatgaaataagttcttggaaattaagccatttattttaatttgctatttttttcaatgttctaggtatctttaaatttgttattgtggaatcattttcctgccagatacctttatcaaaattattggcctcatgagagctgaagtaagtcagctttttggtgaactttagtggacttctgtgagattgtagttgtactttgtatctctaaatctaaagatagttttttaaaactcccaaagaaaatctgctctcctttctgatctaaaaactcatctttggggtaaagagttaagtgtccaaaggttgtcacagttcatgaggtcagagggagctagcctggcacctggactctgcccatccacagctgacagattccaacagaagtgtatttaaattctccagtagacaatgctgggtaagggagggggtagggctgggttattaagatacaggctgctgtattttacattggttgtgtgggaaggggagcctggagaaaacaaagtcactattcccttttttgaaacaggaaaaaaaattattttttgttcagtaaaaatggtagagaattccaatgtccctagccacaagggaccagttccactgagaagtgaacagtgggaactcaaaatttcagaaacattgggggaagggaaaattggctttctcttaattggcagatgttccagtggggggggggggggctctgtttttgttgggatgtgttatgttgtatgtacgcatatatggaccggagtctgctgagtttataaggttccaaaaatatggtaaaatcttggtttttgttaatttatctcaataaaagcccactggaactcc

SEQ ID NO: 125246 - DNA, 2883 bp, Homo sapiens
  Payload ID: 4580
  Gene Symbol: DDX6
  Gene Name: DEAD (Asp-Glu-Ala-Asp) box helicase 6
  ENST ID: ENST00000617381
  CDS Start-End: 318-881
tcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttccgtttttttttctttttcttttaaaaaatgtcttcttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataactttgtaaataagttttttttctgggttcatatatatatatatatatacatatatatatatttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaacatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctacagatgcctcctgatgggacatagccctaactccttaacaactgtagcaagaactgcacggtacaaacccaaaaaagaacaagctcatctatttggaaccc

SEQ ID NO: 125247 - DNA, 3264 bp, Homo sapiens
  Payload ID: 4581
  Gene Symbol: DDX10
  Gene Name: DEAD (Asp-Glu-Ala-Asp) box polypeptide 10
  Uniprot ID: Q13206
  ENST ID: ENST00000322536
  CDS Start-End: 130-2757
aaaagctcgggggcgggcttctgagttcgcgcatgcgcctctgtgcgtttgtcccatgctggttccgtgagtctggccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaagataaatgtaaatgaaatcacaagattttcagattttcccttgtccaaaaaaacattgaaaggtttgcaagaagctcagtaccgtttggtgactgagatacagaagcagaccattggattggctttgcaaggtaaagatgtacttggagcggccaaaactggatctggcaagactctggcttttcttgttccagtgctggaagccttatatcgtctgcaatggacttcaacagatgggctgggggttctcataatatcacctacgagagaactggcctatcagacctttgaggttctccgaaaagtaggaaagaatcatgacttctcagctggtctcatcattggtggaaaggatctaaaacacgaagctgagaggatcaacaacataaatatactcgtgtgcacaccaggtcggcttcttcaacacatggatgaaacagtatcttttcatgctaccgacctccaaatgttagttcttgatgaagcagatagaatcttggatatgggctttgctgataccatgaatgctgttattgaaaatctccccaagaaacgtcagactttacttttctcagcaacacaaactaaatctgtaaaggaccttgcacgcttgagtttgaaaaaccctgagtatgtctgggttcatgaaaaagcaaaatatagcacccctgccactttggaacagaactacatagtctgtgagctgcagcaaaaaataagtgtgctgtattcctttttgagaagccatctgaagaagaagagcattgtatttttttccagttgcaaagaggtccagtatctgtaccgagtgttttgccggctacgtcctggtgtttctatccttgcactccatggtcgacagcagcaaatgagaagaatggaagtctataatgagtttgtccgtaagagagctgcagtactctttgctactgatattgcagccaggggtctggatttcccggccgtgaattgggttcttcagtttgattgtcctgaggatgccaacacatatattcacagagcaggtagaactgccaggtacaaagaggatggtgaagctttgctaattttgctaccctcagaaaaagctatggtgcagcagcttcttcagaagaaagtacctgtgaaggaaatcaaaatcaatccagaaaaacttatagatgtccagaaaaaattggaatctattttagctcaagatcaagatttaaaagaaagagctcaaaggtgtttcgtctcctatgtacgatctgtatatctgatgaaggataaagaagtatttgatgtgagcaagttacctatacctgaatatgccctgtctcttggtcttgctgtggcaccacgcgtaagatttcttcagaaaatgcagaaacaacccaccaaagaattggtaaggagccaagccgataaagtaattgagccaagggctccctccctcaccaatgacgaagtggaagaatttagagcctacttcaatgagaaaatgtccatccttcaaaaaggtggaaaaagactcgaagggacagagcacagacaggataatgatactggtaatgaagaacaggaagaagaagaagacgatgaagaagaaatggaagagaaactggcaaaagcaaaaggatctcaagccccatctcttcctaacaccagtgaggcacagaagatcaaggaagttcctacacagttcttggacagagatgaggaggaagaagatgctgatttcttgaaggtgaagcggcataatgtgtttggattggaccttaaagacgagaaaacattacagaagaaagaaccttctaaatccagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataagtgataccaagaagaagcaggggatgaagaagaggagcaacagtgaagtggaagacgtgggaccaacaagtcataacagaaagaaggccaggtgggacactttagagcctttggataccggcctgtctttagcagaggatgaagagctggtgttacatctgctaagaagtcaaagctaaatacttcctgcgcctgccttctccttgaaaccttggttatgactgcgtaggcaagaagttgaaaaacagttgatttgggggcacttaggtaccatatgccccattcccaaagggcacatttctggatagaagcgatcgtatctccaagtccctctcacaggacatgctttgtgccatcactgagcatactcagatcgagggtggatgataccatttcctgaccccgttttccagcatgtgttctgttagatttttatccatgggttcctacgccttgtcattggaaacactgcctttgtcttactggcaagttctggagctcttgtgtcattgttagaaatccctgtcttgcttactgtacagaagtttctgttgctgttaaaattgctcatgatttcgacgtatttaatattttcaaagagactatgatggaccagccctgagaaagaatgagtatttttgaattgagatgatcaataataaacatatttcctataaaagaaagta

SEQ ID NO: 125248 - DNA, 6707 bp, Homo sapiens
  Payload ID: 4581
  Gene Symbol: DDX10
  Gene Name: DEAD (Asp-Glu-Ala-Asp) box polypeptide 10
  ENST ID: ENST00000526794
  CDS Start-End: 33-2540
ggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagttgaggaagcaactgaagaaacccgaatggcaggtcgagcgcgagagtatcagccgcctcatgcagaactatgaaaagataaatgtaaatgaaatcacaagattttcagattttcccttgtccaaaaaaacattgaaaggtttgcaagaagctcagtaccgtttggtgactgagatacagaagcagaccattggattggctttgcaaggtaaagatgtacttggagcggccaaaactggatctggcaagactctggcttttcttgttccagtgctggaagccttatatcgtctgcaatggacttcaacagatgggctgggggttctcataatatcacctacgagagaactggcctatcagacctttgaggttctccgaaaagtaggaaagaatcatgacttctcagctggtctcatcattggtggaaaggatctaaaacacgaagctgagaggatcaacaacataaatatactcgtgtgcacaccaggtcggcttcttcaacacatggatgaaacagtatcttttcatgctaccgacctccaaatgttagttcttgatgaagcagatagaatcttggatatgggctttgctgataccatgaatgctgttattgaaaatctccccaagaaacgtcagactttacttttctcagcaacacaaactaaatctgtaaaggaccttgcacgcttgagtttgaaaaaccctgagtatgtctgggttcatgaaaaagcaaaatatagcacccctgccactttggaacagaactacatagtctgtgagctgcagcaaaaaataagtgtgctgtattcctttttgagaagccatctgaagaagaagagcattgtatttttttccagttgcaaagaggtccagtatctgtaccgagtgttttgccggctacgtcctggtgtttctatccttgcactccatggtcgacagcagcaaatgagaagaatggaagtctataatgagtttgtccgtaagagagctgcagtactctttgctactgatattgcagccaggggtctggatttcccggccgtgaattgggttcttcagtttgattgtcctgaggatgccaacacatatattcacagagcaggtagaactgccaggtacaaagaggatggtgaagctttgctaattttgctaccctcagaaaaagctatggtgcagcagcttcttcagaagaaagtacctgtgaaggaaatcaaaatcaatccagaaaaacttatagatgtccagaaaaaattggaatctattttagctcaagatcaagatttaaaagaaagagctcaaaggtgtttcgtctcctatgtacgatctgtatatctgatgaaggataaagaagtatttgatgtgagcaagttacctatacctgaatatgccctgtctcttggtcttgctgtggcaccacgcgtaagatttcttcagaaaatgcagaaacaacccaccaaagaattggtaaggagccaagccgataaagtaattgagccaagggctccctccctcaccaatgacgaagtggaagaatttagagcctacttcaatgagaaaatgtccatccttcaaaaaggtggaaaaagactcgaagggacagagcacagacaggataatgatactggtaatgaagaacaggaagaagaagaagacgatgaagaagaaatggaagagaaactggcaaaagcaaaaggatctcaagccccatctcttcctaacaccagtgaggcacagaagatcaaggaagttcctacacagttcttggacagagatgaggaggaagaagatgctgatttcttgaaggtgaagcggcataatgtgtttggattggaccttaaagacgagaaaacattacagaagaaagaaccttctaaatccagcatcaagaaaaaaatgaccaaagttgcagaagcaaaaaaagtaatgaagagaaattttaaagtgaataagaagataacatttactgatgaaggggagttggttcagcagtggccacaaatgcagaaatctgccatcaaggatgctgaggaagatgatgacacaggtggtatcaacttacataaagcaaaggaaagacttcaggaagaggacaaatttgacaaagaagaatataggaaaaaaattaaggcaaagcatcgggagaaaagactgaaagaaagggaagccagaagagaagccaacaagagacaagcaaaggccaaagatgaagaggaagcctttctggattggagtgatgatgatgatgatgatgatgatggatttgatccaagcacactcccagatccagataaatacagaagctctgaagattcagatagtgaagatatggaaaataaaataaggtatgtttttactatgggtatgaaatacatacttagtactctcacatcagtcttttaatgaatccaaaagacattactaagagttctactccaagagatgtttgttgcttttttttgatacctttacttagattcctggaaatcctgctgctgtttttttactcattttgctgcagattgttctggtcatgttagggcctttttgattatttctataatccctattaatagatatgagtatgatatatgagttgtgtttttcctttctctattctttttttttttttcttatctttctctgagtcctttatgcctaagtatttgatgcactaaaatctgttctctgcaaacagagttagggttttattttttttcattgtcagagaactctattaaagatactgctaaaaattgtccttgaattttaaaacgtggacattattcttccacattcttttatatggaattaaataacaaaatactggtggggctgggcgctgtggctcatgcctgtaatcccaacactttgggaggctgatatgggaggattgcttgaagccaggagtttgagaccagcctgatcaacaaagtgagaccccaaatctacaaaaacaaatttttttttaataaataaaataatggaacacttgtacagaaacaactcttgacaaattccttcactttaaagtctatttgctattatttatttgctaccattggcagaaacaaatgaaacgtgatgaataataatatgacttgctcaccatttgttttcagagtactatgtattagattacattaagagtttattgatttcaaagttgagaatgttaaacttcatgctcaatctaaaccagtgagcttctttacagaagggaggtactaataacagatagagttagtatgattgaagggaagaggaagcctgatggaacccttgaagtgctagcacagggtgtttgcagttggagaagtaggccatagagagctataatttgttttaaacaagaacattatgaaaaggtcttaaagattttcttaggacaaaatgctgtagagagacagagttactcttcatttgaatcttatgcatatttaaacatgaattattttttaataggaaaattcacttatccaaattcagttttctgaggtgatgccagaaacttccatttgctgttggacaactaggtggttgaacatatgagctttatatagtatgtgtaggctctaggtagtggacatcattgttttactaccacaagaggcaccacagataaaaataatttgattaggatttagaaaaatatacaaatgtttgtgccataaggattaaataatttaggttctgggcatattcctaatctttaaaaattgacctctaagagtaaatatacatgctctgagttccttggtgtatggtctgagacctagatgaaccccagtggggtcaggtttgcttccccttgtgttcctatataaatgcacctcttttagaatggtttatggggtctgtattttggtagatgtgatttaatgtaacatacatgactttcagtcattgtcttccaagtgtttccatgtaacttgactccctggaagcaacattaattggttcttgcatttctgcagccatattttgcatatctatctaatatacctttaaaaaatagtcaacctttgaaacctttggcaggatgtcagcagtccttctgcatttgatttatatggattttttccctaacattttagatagtttctgggtcatctttcatctgtgtacagcaggcatttcatttaattcttctgccatttcttgcccttatagtgacatttccatgctaccacctagttaatagaacttgttctctagtagctcatgtgtttcatcctgttaattggctgtaaatgttttgtacctagaaattgtccttacattttttttttggtaccaacacttaactgctctagcctcaattcccacccctaatattaatgtcatggcacagagaatgccttgacatatttgaattgattaattgattgatgaaggagatttacagggttaaaaaagaaatgtaattataagagactatatcattggtcctaatattaataggttaaatgatacaagagatgacagaatatagatggagagttggaagaagccaagttcatacagtgtaatggtgatgaacaagaaggtaggagtactgtgagagatgacaaagcatcttaacttaaagacaagggttcagatggaaagtatttaagcattatatgaaaattaaaacagttttaatttcatgcacagctaacaagtcagcattagtggagactgggattggtcaacttgttttaagctgacagaaattgtcttttgttgaagaggaggatatcaacaagggcttgatcactgatgagggattttattcctgtagcgtatataagggcttcctagcaggttttttgttttggcctgtgaacacagagattgtctaatcttatagcctccttctagatgaaaaaaccaaggctttaaaggctaaaataacttgtctgtgatcacaataaaagttagggacagatcagtgtgatctttgtaaattaaactaactccctagttctagaatctcagttaggttgtatagaattaccctggtgttgagagaggtagctcaggataatgtcatttgactaaacacctggatccatggactaaccataagatagacatggtttcccaccctcagcattattgatattccggcccagatagttttttgtttgagaaagggtataagctgcttaacatcatccttggcctctaccactagcatttgggacaactaaaaatgtcttcagacatggcaggtatctctgaggaagcaaaattgcccacagttgagaacaactggattagaccccagatggcagatacatattactggtgcttaatttcccctgtccttcagtcagagtaggttttttctctattcacttccatttggcctaagcagtcctcagcacagtctctgtcaatcaattggaactggtacggaaggtaaaacctatttgccattcctggactagcaggcaggatttggagtaaattataagtagtagcctacatctgtaatttctatttatactttaatttccatttttctcccttttctgtggtttatttgcctcaatggcaatgaatcaagatgtatgtaaactaaaaccaaaattgttttagataaagaaaatgtatttggaagattgtatatactagaattttgacagtggtaattgctgttgctgctagcatttgcatagtagcgccagtaaagtttttctgtattcttccagtttggctacacactggaagcatacagcttccatctgcttatgcttctcataagctgtatgattacgtgctaagatcttatgatgtcagctttagtgagtcctcttgacatgttcacaggttttacttgctgtgctgtctctagccctctactcagtaattgaggcaatggctagtactccagcctcttggacatcatcacatctctcagtaggttattctctggctatacacttagcattttcagagacgaattcactcttatgggactagatagaccaattggaaagtagctattagtcctggccgggcgtggtggctcacacctgtaatcctagcacttcaggaggccgagatgagtggatcacgaggtcacgagatcgagaccatctggctaacacagtgaaaccccgtctgtactaaaaatacaaaaaattagctgggcatagtggtgggcgcctgtagtcccagctgctggggaggctgaggcaggagaatggtgtgaacctgggaggcggagcttgcagtgagccgagatcgtgccactgcactccagcctgtgcgacagagcaagactcccagagagagagagccgagcacagtggctcacgcctgtaatcccagcactttgggaggccgaggtgggcggatcacaaggtcaagagattgagaccatactggccaagctggtgaaaccctgtctctattaaaaatacaaaaattagccgggcgtggtggcgggcgcctgtagtcccagctacttgggaggctgaggcaggagaattgcttgaacctgggaggcagaggttgcagtgagccgagattgtgccactgcactccagcctgggcaacagagggagactccatctc

SEQ ID NO: 125249 - DNA, 3796 bp, Homo sapiens
  Payload ID: 4582
  Gene Symbol: DDX18
  Gene Name: DEAD (Asp-Glu-Ala-Asp) box polypeptide 18
  Uniprot ID: Q9NVP1
  ENST ID: ENST00000263239
  CDS Start-End: 129-2141
ccagcgttcctgtgacgcgtttcctgttggccgagctgcgcacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaaggttaaaaaatcaaaacaaaagcccatgaatgtgggcttatcagaaactcaaaatggaggcatgtctcaagaagcagtgggaaatataaaagttacaaagtctccccagaaatccactgtattaaccaatggagaagcagcaatgcagtcttccaattcagaatcaaaaaagaaaaagaagaaaaagagaaaaatggtgaatgatgctgagcctgatacgaaaaaagcaaaaactgaaaacaaagggaaatctgaagaagaaagtgccgagactactaaagaaacagaaaataatgtggagaagccagataatgatgaagatgagagtgaggtgcccagtctgcccctgggactgacaggagcttttgaggatacttcgtttgcttctctatgtaatcttgtcaatgaaaacactctgaaggcaataaaagaaatgggttttacaaacatgactgaaattcagcataaaagtatcagaccacttctggaaggcagggatcttctagcagctgcaaaaacaggcagtggtaaaaccctggcttttctcatccctgcagttgaactcattgttaagttaaggttcatgcccaggaatggaacaggagtccttattctctcacctactagagaactagccatgcaaacctttggtgttcttaaggagctgatgactcaccacgtgcatacctatggcttgataatgggtggcagtaacagatctgctgaagcacagaaacttggtaatgggatcaacatcattgtggccacaccaggccgtctgctggaccatatgcagaataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagggatatgttgtttgtccttctgaaaagagattccttctgctctttacattccttaagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatttgacttttcctggtctaaaatttctgacattcagtctcagcttgagaaattgattgaaaagaattactttcttcataagtcagcccaggaagcatataagtcatacatacgagcctatgattcccattctctgaaacagatctttaatgttaataacctaaatttgcctcaggttgctctgtcatttggtttcaaggtgcctcccttcgttgatctgaacgtcaacagtaatgaaggcaagcagaaaaagcgaggaggtggtggtggatttggctaccagaaaaccaagaaagttgagaaatccaaaatctttaaacacattagcaagaaatcatctgacagcaggcagttctctcactgaacacatgccttcctttcatcttgaataactttgtcctaaaatgaattttttttccccttgatttaacaggatttttgtagactttagaatttggacttacctaacaagagtataaattgacttgggttgcaagcactgagcactgttacttctatcacgtctctcttttatttctgggatataaaacaggctttaagtttcttggttgcccaagggcagagcaaggaatatctggtgtttcttgtgatgataatattttaattttaaatatccctccctcatacaagtgtatgttaccattttaatataattctttttgtacctttccttcttgttttgcgaagatttttgtggcatggattgctgtgctcactgctgtaaaaggtgacctagtgtactgggcagctggtggcggtgcagaaaagagtctcaggttattttttgtttttagttatttcttggaccttgacagtatctaatgactcctcctgaaaatgctgcagtataaaagagcaaagagctttgggaaatacctaagaagcaccttaagattagggtggcattgcttttatagattcttgattttaaagcaacaggcctttctcaggtgttgcattttttggagcaaaaactatgggttgtaatttgaataaagtgtcactaagcagttataacgtttgatggctggggggtaggaagaggatggaattgagatgtttgagcctcatttacatcaatagaggtgtaatgtactgcatttcttcatttggtaacataacaaagactttcatacaaagaacgatgatgctcctcattaagatttgtttaattcaaggtggtttggatttggtaagcctttgcactctgtagagtacttagaagacaagggcaacttacttggagttagagccaagctgtcagacggtgcccagcacacattaatgttagcttctttctgagaaaaaaatacctcttccaggccctgaaacaaaaaatacatttgctgtgaagattgaaaatgaacaaagttagaaaaaaaaacagcaaaatcagtgatttagtcagatgagtttttcgttgtaggagcacttgatttctagtgtgttttgtacagtatataactacaagatagtacattttgtagcagttcaaagccaaagttgctagcatcattttgctgttgtgccagttaatcataggatcccattaaataagtgtgctaacatcgaatatagagaaaactggtaaagaacattccagtaggaaaagaaaagaacaatcttccatttctgggcttggccaccatcaccctggtcggacctgtcctggacttccaaccttgactgctgagctcctggcttagcttcttgggttcctaattcctggtgtttaataattctctccacgatcatgtttttctgattttttttttcagaaataatgttttttaaaagacaaaaacaaagggaagaatatttaattactgagcagaagtaaatactgttggcattttgtacataatctaatttttatatgcatgttcatgctttttaatttttttatcaaaaattaagtcatctacctactacttgtaaccagcttgtttcataacatgttattttcctgtgtcattaaataattacttcaatgttgta

SEQ ID NO: 125250 - DNA, 644 bp, Homo sapiens
  Payload ID: 4582
  Gene Symbol: DDX18
  Gene Name: DEAD (Asp-Glu-Ala-Asp) box polypeptide 18
  ENST ID: ENST00000415038
  CDS Start-End: 1-644
aataccccaggatttatgtataaaaacctgcagtgtctggttattgatgaagctgatcgtatcttggatgtggggtttgaagaggaattaaagcaaattattaaacttttgccaacacgtagacagactatgctcttttctgccacccaaactcgaaaagttgaagacctggcaaggatttctctgaaaaaggagccattgtatgttggcgttgatgatgataaagcgaatgcaacagtggatggtcttgaacagaagaaccgaaagaagaagcttatggtcttcttttcatcttgtatgtctgtgaaataccactatgagttgctgaactacattgatttgcccgtcttggccattcatggaaagcaaaagcaaaataagcgtacaaccacattcttccagttctgcaatgcagattcgggaacactattgtgtacggatgtggcagcgagaggactagacattcctgaagtcgactggattgttcagtatgaccctccggatgaccctaaggaatatattcatcgtgtgggtagaacagccagaggcctaaatgggagagggcatgccttgctcattttgcgcccagaagaattgggttttcttcgctacttgaaacaatccaaggttccattaagtgaatt

SEQ ID NO: 125251 - DNA, 2997 bp, Homo sapiens
  Payload ID: 4583
  Gene Symbol: DDX19A
  Gene Name: DEAD (Asp-Glu-Ala-Asp) box polypeptide 19A
  Uniprot ID: Q9NUU7
  ENST ID: ENST00000302243
  CDS Start-End: 164-1600
agaatgatgatgtcgcacgctgggtgggaactgacgtcacctgtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaagg

SEQ ID NO: 125252 - DNA, 1703 bp, Homo sapiens
  Payload ID: 4583
  Gene Symbol: DDX19A
  Gene Name: DEAD (Asp-Glu-Ala-Asp) box polypeptide 19A
  ENST ID: ENST00000417604
  CDS Start-End: 49-1392
cgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctcccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggcta

SEQ ID NO: 125253 - DNA, 551 bp, Homo sapiens
  Payload ID: 4583
  Gene Symbol: DDX19A
  Gene Name: DEAD (Asp-Glu-Ala-Asp) box polypeptide 19A
  ENST ID: ENST00000566167
  CDS Start-End: 97-240
gtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctagtcccactctgtcaccctggttggagtgcagtggctcagtcacagatcactgcagccttgacctcctgagctcaagtgagcctcccacctcagcctcttgagtaactgggactacaggaaaccacagcttctccagggagtctatgccatgggcttcaatcgaccctccaagatacaagagaacgcattacccatgatgcttgctgaacc

SEQ ID NO: 125254 - DNA, 577 bp, Homo sapiens
  Payload ID: 4583
  Gene Symbol: DDX19A
  Gene Name: DEAD (Asp-Glu-Ala-Asp) box polypeptide 19A
  ENST ID: ENST00000561574
  CDS Start-End: 88-243
attctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgagacggggtttctccatgttggtcaggctggtctcgaactcccgacctcaagtgatccgcccacctcggcctcccaaagtgctgggattacagccgtgagtcaccgcgcccagccgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgat

SEQ ID NO: 125255 - DNA, 1643 bp, Homo sapiens
  Payload ID: 4583
  Gene Symbol: DDX19A
  Gene Name: DEAD (Asp-Glu-Ala-Asp) box polypeptide 19A
  ENST ID: ENST00000569319
  CDS Start-End: 88-324
attctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaaggaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaatcagaagagaccaagactgaggggaacactcatgtgtgttttgaaatctggaaataacttgttctcctagtcctagaaggatgggcagggctttgatttccagagctggctttgcctttgaaatacctatgaaaatcacctgggtctccacagtggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcaga

SEQ ID NO: 125256 - DNA, 3067 bp, Homo sapiens
  Payload ID: 4583
  Gene Symbol: DDX19A
  Gene Name: DEAD (Asp-Glu-Ala-Asp) box polypeptide 19A
  ENST ID: ENST00000569771
  CDS Start-End: 110-499
gcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaaccgtgagtatgcagatgaagcgcatctcacccagtgtgattagatcaatcttccccaaactgcgtttttgtgcctgagaacagaaggagctgtttggggccacgtgtttcctcaggaatacagcttagcccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaagaaacgatagatgtgcaggttgtgcggaagaggctgagtggaaaatggtgtgagccccaccgctgtgcatcgaatgagggaagtggcagcagagaggccagagctgccccctctctgtctcttcaatggacccttcacaagtgtttctcctgcccttggggctgtcttccttctcctgaaatccagagactttcttgctcatcccttctccctttcacttctgttctctgctgcagaaagcagacttgcatatccctgatgagcagctcggctacttttgtaaacttcagatttggagagaaacacgaaagtctgaatcctgaccccttgagagagagtgatctggcgagggccgatgaaggggctgggcctggtcttgccttctcttctctcggttgctccctctgcctaggcccctggtactcagtcacggcagccaggagaccccaggtgagtttctgagcgcatacgtagttggttcttacccccaggtgtcacacggggccgagagctgagcaagaatttggaatggaagttatgaccaagggaattatgctgttcatttataatagtggacattatggagagctctgattcctacataatatgaataaggatggataggccgggcgtggtggctcatgcctataatcccagcacgttgggaggctgaggcgggcggatcggttgagctcaggcgttcgggaccagcctggccaacatgatgaaaccccgtctctaccaaaaatagaaaaaaatatagccgggcctggtggcgcacgcctgtagtcccagctactcgggaggctgaggtaggaggatcgcttgagcctgggtagaggctgctgtgagctgaaatggcgccactgcactccagcctgggtaacagagcgagaccccgactcaataaataaataaggatggataaattgtagcgtatgcaccattcattatgctaagacattttaaagtaattatgagaaacgctctactaatgatttgtttttatttgtatttttctgcttattagacaaatatatactcattttaaaaa

SEQ ID NO: 125257 - DNA, 1533 bp, Homo sapiens
  Payload ID: 4583
  Gene Symbol: DDX19A
  Gene Name: DEAD (Asp-Glu-Ala-Asp) box polypeptide 19A
  ENST ID: ENST00000575878
  CDS Start-End: 1-1190
attggctgacaggtgatttctggatgtcaggaacatttctgattaggaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaattggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgtttggacttgacaaaaataggtgcaaatgatggggggcaatagaagaaaaaatttgcattttggaaaattgggtcctttccccacttttttaaagccacattcccccatctttataataatctggtcacagtggtagtcgctggccccaggaccccctcctgattttggctaggcatcgtggaaccagctccagcccctgaaga

SEQ ID NO: 125258 - DNA, 557 bp, Homo sapiens
  Payload ID: 4583
  Gene Symbol: DDX19A
  Gene Name: DEAD (Asp-Glu-Ala-Asp) box polypeptide 19A
  ENST ID: ENST00000562649
  CDS Start-End: 88-282
attctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagataccccc

SEQ ID NO: 125259 - DNA, 3386 bp, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENST ID: ENST00000288071
  CDS Start-End: 246-1685
gataggaaagcttgctctgcccggggttgaggggtacgggtctgagggcaacagaatcgacagcctcaagtgggcaaagggtggccaaacaggagtggcctccgacgtcactgtggcgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaagtttcatcttttaatttggccagtgtttccttcatgctaatctagatgctgtggctgattacttgcccaggatctcctgtggcagcctctgcttgttctctggcttggagtggatggggcagcctccagctcctgtggaagtaatggaatagtggtggaaagggaacacagagagggaggcttccagtaagataggtgtgtaagcccagccatcatgtttggaatggcatgaggcagcagaggaggcctgagagctgctgctttggacttgggggtgggacagctcatctgagtattgccagccccctgtcctagtgcccacagcagaagggaatttgttaaataagcatggaccaaaatgccaacctctcggttgtgtatatgggtttgtgtcacaggactgtgacctgttctcggtgggtgcagtctgtgtagagtgcacatctgattattggtgggtcctgtgcctgtgcttaagcaagtcctgtggagaagtcatcatggagaattagtggtggccctagcgtgccacaaaacctggtctcatgagcatttgcaacatcccttttacatccttaatatccccttaccccacagtagccccaaacaaatgtgatctgaggtttagatcctcagtgaaaattgtggtttcaagtcttcatggccagcctcaaggcagttctagatgtgatcagcagtagtcacaaattcttgttttgtctccacacccagaaggcaagttttgtcagagctggggaataatttcagatatttgacatcttgattataaagggcttctgaacatctgtgtttactgcctttggaatacaaacaggtgcaactgagggactagctacactaccaccatttatctgtccaaggcaagagtatcaccaaggcctttgctccagccttacttggcatctttgcgcaagatagtcagagcaaacaatagtaatggacacttctcacacctggccaaggctgttggtacccacgaaatgacagcaaagatgagaggaaactgaattgcaagagcaatatgaaaccccaaccaagaggagtactctgcagttctttggctttggtatagagtggccactttctctaggacctggaagaagagtttgatggctaagaacgattgtgatcctaggtcttctttgtacgcatctccgtatttaggccagatctgcctcctgggaagggaaggggccaatgtcagcctccaggtgatttctttaatctgacattacaaagagaccaacagactgccaattctaccacattcccctggtgggtactcgactatgtagttttctctatgcttctggtcaactctgacacatcttggaattcttgtaataagaaaagaaatttttatacttttttctccttccctgagtcctgtggaccaaccctgaaatactaaaaacaagggcaataattaaagaa

SEQ ID NO: 125260 - DNA, 1692 bp, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENST ID: ENST00000355992
  CDS Start-End: 105-1451
gtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttt

SEQ ID NO: 125261 - DNA, 1717 bp, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENST ID: ENST00000393657
  CDS Start-End: 361-1473
actgtggcgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttgg

SEQ ID NO: 125262 - DNA, 1608 bp, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENST ID: ENST00000451014
  CDS Start-End: 50-1411
agtgccaagagcagcggttgttggagtgtaactgccatgctcagccgcgatggctggggctgccgggcgcgtccaagatcgcgccctgcggcggtttcccatcaccctgcctgtgggcgacttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttac

SEQ ID NO: 125263 - DNA, 726 bp, Homo sapiens
  Payload ID: 4584
  Gene Symbol: DDX19B
  Gene Name: DEAD (Asp-Glu-Ala-Asp) box polypeptide 19B
  ENST ID: ENST00000566216
  CDS Start-End: 26-726
tgggaaggcggctctaacttggctgatgcaactgcgagaaaagttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcat

SEQ ID NO: 125264 - DNA, 818 bp, Homo sapiens
  Payload ID: 4584
  Gene Symbol: DDX19B
  Gene Name: DEAD (Asp-Glu-Ala-Asp) box polypeptide 19B
  ENST ID: ENST00000568008
  CDS Start-End: 130-228
cgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgcc

SEQ ID NO: 125265 - DNA, 1790 bp, Homo sapiens
  Payload ID: 4584
  Gene Symbol: DDX19B
  Gene Name: DEAD (Asp-Glu-Ala-Asp) box polypeptide 19B
  ENST ID: ENST00000562519
  CDS Start-End: 157-249
caggagtggcctccgacgtcactgtggcgcgccgcttccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttttggaagtttcatcttttaatttggccagtgtttccttcatgctaatctagatgctgtggctgattacttgcccaggatctcctgtggcagcctctgcttgttctctggcttggagtggatggggcagcctccagctcctgtggaagtaa

SEQ ID NO: 125266 - DNA, 1765 bp, Homo sapiens
  Payload ID: 4584
  Gene Symbol: DDX19B
  Gene Name: DEAD (Asp-Glu-Ala-Asp) box polypeptide 19B
  ENST ID: ENST00000563206
  CDS Start-End: 70-1524
aatgaggctccggcttggccagtgccaagagcagcggttgttggagtgtaactgccatgctcagccgcgatggctggggctgccgggcgcgtccaagatcgcgccctgcggcggtttcccatcaccctgcctgtgggcgacttgagcaacttgcatcttaaggaagagaaaatcaaaccagataccaatggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttaccttt

SEQ ID NO: 125267 - DNA, 1760 bp, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENST ID: ENST00000563392
  CDS Start-End: 410-1522
gcccccggctcccggaggtcgacattttggtttccataggcaaagtcctaacaccacaattgacatagttaaaaaggggagacggtaacgtgtttggtagaggttacatatcttgctatagttgtttattttagttgctgagtgatacacagccctcaaagagtctgacattgtgcccatggttacacttgtccgggggagaccttgaatttggtgtggaagaaataacatcagtagttcagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagagaaactacctacctcacttcaaattatgtttggacttgacaaaaatgtatgcaaatgatgggggatggtagaaaaaaattatttacacaaccttggaagattaggcatgaatacacagagatttacc

SEQ ID NO: 125268 - DNA, 1681 bp, Homo sapiens
  Payload ID: 4584
  Gene Symbol: DDX19B
  Gene Name: DEAD (Asp-Glu-Ala-Asp) box polypeptide 19B
  Uniprot ID: Q9UMR2
  ENST ID: ENST00000568625
  CDS Start-End: 456-1568
atgctcagccgcgatggctggggctgccgggcgcgtccaagatcgcgccctgcggcggtttcccatcaccctgcctgtgggcgacgtgagtatctgcgagggtagaagccagaccctttcctcccacgtttaggtgccttcctcgcccctactcctgggtagaggaataacaatatttctcgaggcttcggcccaaggtcttagccttgtgatctagaatccgccatctgtgaggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagtttgcccagaaagtggtcccagacccaaacgttatcaaactgaagcgtgaggaagagaccctggacaccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggaacagagggctgcagtgattgagcgcttccgagagggcaaagagaaggttttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcgttcagggcacaggccccgacatcaccccaaggacaacggcacaagtagagaga

SEQ ID NO: 125269 - DNA, 879 bp, Homo sapiens
  Payload ID: 4584
  Gene Symbol: DDX19B
  Gene Name: DEAD (Asp-Glu-Ala-Asp) box polypeptide 19B
  ENST ID: ENST00000568408
  CDS Start-End: 90-215
cagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcgttgagcaacttgcatcttaaggaagagaaaatcaaaccagataccaatggcctttacaaaaacttctagtgtcatagaatttgaattgtctcaactgttgggtatgggatgcgattttgaatgatggccactttgtgtctataaaggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctcccacagaacttaattgcccaatctcagtctggtactggtaaaacagctgccttcgtgctggccatgcttagccaagtagaacctgcaaacaaatacccccagtgtctatgtctctccccaacgtatgagctcgccctccaaacaggaaaagtgattgaacaaatgggcaaattttaccctgaactgaagctagcttatgctgttcgaggcaataaattggaaagaggccagaagatcagtgagcagattgtcattggcacccctgggactgtgctggactggtgctccaagctcaagttcattgatcccaagaaaatcaaggtgtttgttctggatgaggctgatgtcatgatagccactcagggccaccaagatcagagcatccgcatccagagg

SEQ ID NO: 125270 - DNA, 586 bp, Homo sapiens
  Payload ID: 4584
  Gene Symbol: DDX19B
  Gene Name: DEAD (Asp-Glu-Ala-Asp) box polypeptide 19B
  ENST ID: ENST00000568460
  CDS Start-End: 107-253
ttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagcccccacagaacttaattgcccaatctcagtctggtactggtaaaacagctgccttcgtgctggccatgcttagccaagtagaacctgcaaacaaatacccccagtgtctatgtctctccccaacgtatgagctcgccctcc

SEQ ID NO: 125271 - DNA, 569 bp, Homo sapiens
  Payload ID: 4584
  Gene Symbol: DDX19B
  Gene Name: DEAD (Asp-Glu-Ala-Asp) box polypeptide 19B
  ENST ID: ENST00000562912
  CDS Start-End: 121-267
tccggtctgcagccttgtagtggggctggagcagagcctgccgcgaacccccggagcccacgatccctcgtgccatccctcgaatccaccagcacgagcgtcccacccgcgcctgggaccatggccactgactcatgggccctggcggtggacgagcaggaagctgcggctgagtcggtgctgttgtcaagaccaatgccaatgcagagaagacagatgaagaagagaaagaggacagagctgcccagtccttactcaacaagctgatcagaagcaaccttgttgataacacaaaccaagtggaagtcctgcagcgggatccaaactcccctctgtactcggtgaagtcttttgaagagcttcggctgaaaccacagcttctccaaggagtctatgccatgggtttcaatcgtccatccaagatacaagagaacgcattgccactgatgcttgctgagccatattttagggcaagtgtggtggctcatgcctgtaatcccaatactttgagaggccgaggcaggcagatcgcttgagcccaggagttcgagaccagcctgggcaacatg

SEQ ID NO: 125272 - DNA, 4212 bp, Homo sapiens
  Payload ID: 4585
  Gene Symbol: DDX20
  Gene Name: DEAD (Asp-Glu-Ala-Asp) box polypeptide 20
  Uniprot ID: Q9UHI6
  ENST ID: ENST00000369702
  CDS Start-End: 621-3095
gtgcgccagggacttgctaggagataaatggggtttatctcaccggagataaatgtggttgcacagcagatggacacaccagccaatgtggtaaataaacccttgggtccagctacgttctgcgcgctctctgccagcacagaggagcagcgagtcagggtacggagcgggtagcgttggggaagaggtggccgcgaagcgagacaggccagcggaacggaaaacggaagcacgagacgggggcgtgacgcaccgggcgcatcacaaagaacggcgagagggcggtggcgccgggggcacggctgggcggctccgcccagaagagggccgagaggcggggcggtgcccccaccgcaggcccgcggcgccctctgcaggccacaggcagcgactcaccagttgcctcatctttcctctcctccctcttggggctttcctcaggccacattttttgtgtgtctgggcagtctctcagcctccgactcccgtccctttcttccacttccaggccgggcgtgttagtgtcttcgcgggaaaactgccaataaagtttttcttcttctcgctcccaagatccccgcctccccttaagcaccgcgagatctgacggcgcggctaccatggcggcggcatttgaagcctcgggagccttagcagcagtggcgactgctatgccggctgagcatgtggccgtgcaggtcccggccccagagccaacacccgggcctgtgaggatcctgcggaccgctcaggatctcagcagcccgcggacccgcacgggggatgtgctgttggcggagccggccgacttcgagtcactgctgctttcgcggccggtgctggaggggctgcgggcggccggcttcgagaggccctcgccggtgcagctcaaggccatcccgttggggcgctgcgggctcgatttaattgttcaagctaaatctggcaccgggaaaacctgtgtgttctccaccatagctttggactctcttgttcttgaaaacttaagtacccagattttgatcttggctcctacaagagaaattgctgtacagatacattctgttattacagccattggaataaaaatggaaggcttagagtgtcatgtctttattggagggaccccattatcacaagacaaaaccagacttaaaaagtgtcatattgctgttggatctcctggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtttgaagcagtattacaaagttgtcaattcataccctttggcacataaggtttttgaggaaaagactcagcatttacaggaactgttcagcagaattccatttaatcaagctttagtcttttctaatttgcacagcagagcacaacatttggctgatatcctttcttctaaaggctttcctgctgagtgcatttcaggcaatatgaatcagaatcagcgtcttgatgctatggctaaactgaagcactttcattgcagagtcctcatttccacagatttgacttctcgtgggattgatgctgagaaggtgaatctggttgtaaatctggatgtaccattggattgggagacatacatgcatcggattgggagagctggccgttttggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaaccaacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacgtcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttattgaacagagagtccctgtgttggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaatattattgctgtggagttctttacaaagggcttaggctgcatttccttctatagaggtgcattcttgtagaaatttgtagcatggtagatcagaaaatcctcttaggttttaggcaggaaggaatatttaaacattgctttagattttcctaaaggtatttgatttgatctgttagcttccagtaaaaatatttgtttttagtaaaaacaaatttaaatatatttacatgtttgttgtttatcttttgaatgtcttttgaggctgtgaaagctgtccacatttttgctgtgtattaaatagctgtgggtcatcagttgctgtcttacttgtgttgctcagatagaggagcagctcttaatcttttttggttcttggatccttttatgaatcagctgatagctatagattgacttcaggaaatttctcattccataagcacagaattgtgagtgtaatttcaaggggttcatagaccctctgaagttcatctatacagtccagattaacaagtgacctgctctgctggtaggctaggggaagttctagctcttagttttaagtattttgtggaagctggaattgattctcttcagacacttcttagtacatcctaattttgtgtcttctagaaaattttccccagtttttacctctaatgttaggatccaagaggagcttggatctgagctgatgcatctgtaaattacgatttagaaaaatataattggaaattacatattctttgctttttt

SEQ ID NO: 125273 - DNA, 1499 bp, Homo sapiens
  Payload ID: 4585
  Gene Symbol: DDX20
  Gene Name: DEAD (Asp-Glu-Ala-Asp) box polypeptide 20
  Uniprot ID: Q9UHI6
  ENST ID: ENST00000533164
  CDS Start-End: 263-679
cttgggagctgttagtccagttccaggttccaattcaacgtacttttatcagagctcactgtgcgccagggacttgctaggagataaatggggtttatctcaccggagataaatgtggttgcacagcagatggacacaccagccaatgtggccgggcgtgttagtgtcttcgcgggaaaactgccaataaagtttttcttcttctcgctcccaagatccccgcctccccttaagcaccgcgagatctgacggcgcggctaccatggcggcggcatttgaagcctcgggagccttagcagcagtggcgactgctatgccggctgagcatgtggccgtgcaggtcccggccccagagccaacacccgggcctgtgaggatcctgcggaccgctcaggatctcagcagcccgcggacccgcacgggggatgtgctgttggcggagccggccgacttcgagtcactgctgctttcgcggccggtgctggaggggctgcgggcggccggcttcgagaggccctcgccggtgcagctcaaggccatcccgttggggcgctgcgggctcgatttaattgttcaagctaaatctggcaccgggaaaacctgtgtgttctccaccatagctttggactctcttgttcttgaaaacttaagtacccaggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtttgaagcagtattacaaagttgtcaattcataccctttggcacataaggtttttgaggaaaagactcagcatttacaggaactgttcagcagaattccatttaatcaagctttagtcttttctaatttgcacagcagagcacaacatttggctgatatcctttcttctaaaggctttcctgctgagtgcatttcaggcaatatgaatcagaatcagcgtcttgatgctatggctaaactgaagcactttcattgcagagtcctcatttccacagatttgacttctcgtgggattgatgctgagaaggtgaatctggttgtaaatctggatgtaccattggattgggagacatacatgcatcggattgggagagctggccgttttggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaa

SEQ ID NO: 125274 - DNA, 4332 bp, Homo sapiens
  Payload ID: 4585
  Gene Symbol: DDX20
  Gene Name: DEAD (Asp-Glu-Ala-Asp) box polypeptide 20
  ENST ID: ENST00000475700
  CDS Start-End: 2359-3657
agtagagtaacaatattggctgagatttacacaaatttggtacatcataaatatttcaattttttttttttaattaggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtgtgtacagcttttaggtacttatattattggtttatttgtgatatgctggagctttcccttgcctagttttgtcttgctgtttcatggttaccattagcatatatatttgttttaactgatagctcttctttgtaggtttgaagcagtattacaaagttgtcaattcataccctttggcacataaggtttttgaggaaaagactcagcatttacaggaactgttcagcagaattccatttaatcaagctttagtcttttctaatttgcacagcaggtaatgtaacttaaaaggtcatctggggaacttgtgaaataaaaggatagtcatggggcaatatttgtaaatttgtaaccatttatgttatatttcatagagcacaacatttggctgatatcctttcttctaaaggctttcctgctgagtgcatttcaggtaagttcatctcttactttaatctttatttagtatactgacttgaagcctccaaagtcaggaggaaaaaataccactttatgagttgtcttgagagtgtgaaattatcttgtatcttttagagtaaaggaattttcaggcttatttttcattggaatttgatatgtcaatattctatttttaaggagtaacttggtatatagtaaaaagttagaaaactagtgttcagaaagacaattttattagaatctctcttatagccacatataacttaattctataaaaccaagtttgtctgtattgtgttaagataaaaatattttttctttagaatttttttttttaataattgttaaaatgctggagattgctaactgaattgactgttttatggttttgtggaaggcaaaagtgattgagttcttgctgcaaagttaaatgattactgctggcataataagaatgaaagagtcgaaggattttttgatcagtgagatcctttttagagttttgtttggtgtcagcttaatttttaacctgttggcatgagcttgtttagttatggtatatcacgagatactggggagactattttctaatgaaccaatacttaaactatagatcacactttaacaccaaattataaacagctgattaaagcatttttattttcctaagaattgctagttatacttcatatgtaactttgcaaatagaatgttatatattcaggcatggcctgatcactatttaggattgatttttgaatttcaagttgattgcctaaaccatagtttaaaagattttaactttggatcttaacctagatttgcacagaaggacagaattaactgtggttggtgtattaaaagtgttaagactgggtgttatgctttttactttttgtggattggataaatatgtattagcttagttgtttttatgtgactttcttttggggtccttttaggcaatatgaatcagaatcagcgtcttgatgctatggctaaactgaagcactttcattgcagagtcctcatttccacagatttggtaaatttcctattcagtttgggtgactaatccatcttgacatatgttctattatcagatgtacagatttcatatattattttatgtaggcgtatctaacaagaataccagaagataattatctttccagtgctgaggaaaatactttcttaaaaatgtctttaatatgtttatctttgtccttgaaattagtcattaggaatgaatttccttttcctctgctcctcagtattcagttcttaatttgtctcttgactgtactggaagaatataatatgcattggtatccatgctgtatagttaatgcaaacaaataattgctatcttcttcaattcaagacttctcgtgggattgatgctgagaaggtgaatctggttgtaaatctggatgtaccattggattgggagacatacatgcatcggattgggagagctggccgttttggtaaaaaaaaaaaaaaaagtttgagtgctttctttaaggggagggatctataatgtgacaggtgggctttgaatattatttttgtgaaaatgatttactacctaacattctctctgcttttaggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaaccaacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacgtcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttattgaacagagagtccctgtgttggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaatattattgctgtggagttctttacaaagggcttaggctgcatttccttctatagaggtgcattcttgtagaaatttgtagcatggtagatcagaaaatcctcttaggttttaggcaggaaggaatatttaaacattgctttagattttcctaaaggtatttgatttgatctgttagcttccagtaaaaatatttgtttttagtaaaaacaaatttaaatatatttacatgtttgttgtttatcttttgaatgtcttttgaggctgtgaaagctgtccacatttttgctgtgtattaaatagctgtgggtca

SEQ ID NO: 125275 - DNA, 3248 bp, Homo sapiens
  Payload ID: 4586
  Gene Symbol: DDX23
  Gene Name: DEAD (Asp-Glu-Ala-Asp) box polypeptide 23
  Uniprot ID: Q9BUQ8
  ENST ID: ENST00000308025
  CDS Start-End: 81-2543
atctccgcgaccaggaaacgggaaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggaggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagaggaaaaagctgctggcaatcttggagcaaggctttgacccacccatcattatttttgtcaaccagaagaagggctgcgacgtgttggccaaatccctggagaagatggggtacaatgcttgcacactgcacggtggaaaaggccaggagcagcgagagtttgcgttgtccaacctcaaggctggggccaaggatattttggtggctacagatgtggctggtcgtggtattgacatccaagatgtgtctatggttgtcaactatgatatggccaaaaatattgaagattacatccaccgcattggccgcacgggacgagcaggcaagagtggggtggccatcaccttcctcacaaaagaggactctgctgtgttctacgagctgaagcaagctatcctggaaagcccagtgtcttcctgtccccccgaactagccaaccacccagatgcccagcataagccaggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatgccccaggagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacatgaatattaa

SEQ ID NO: 125276 - DNA, 1377 bp, Homo sapiens
  Payload ID: 4586
  Gene Symbol: DDX23
  Gene Name: DEAD (Asp-Glu-Ala-Asp) box polypeptide 23
  Uniprot ID: Q9BUQ8
  ENST ID: ENST00000547135
  CDS Start-End: 59-385
aaagatggcgacggctccgcgacgttgaggccgcgttgggcggttcagactcagggtgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccaggcactgaagtaagagtgatgtggaccttgttccttttcctcaaagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttgggtacaaagaacggcaccaggtgcagttgttagggcgaggcttcattgcaggcattgacctcaagcagcagaagcgagagcagtcacgtttctatggagacctaatggagaagaggcgaaccctggaagaaaaggagcaggaggagtgagtgatcaaggctagggtggctggacagagcccagaggctctacagaaaggagttggagggcactgattctacttactcctcacaccctgctccagggcaagactccgcaaacttcgtaagaaggaagccaagcagcgctgggatgatcgtcattggtctcagaaaaagttagatgagatgacggacagggactggcggatcttccgtgaggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggatcgaagagtcagaccaaggcccttatgccatcatcctg

SEQ ID NO: 125277 - DNA, 567 bp, Homo sapiens
  Payload ID: 4586
  Gene Symbol: DDX23
  Gene Name: DEAD (Asp-Glu-Ala-Asp) box polypeptide 23
  ENST ID: ENST00000551468
  CDS Start-End: 154-567
aaagatggcgacggctccgcgacgttgaggccgcgttgggcggttcagactcagggtgtagagatggggtttcaccgtgttggccaggatggtctcaatctcctgacctcatgatctgcccgctttggcctccaaaagtgctaggattacacgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaag

SEQ ID NO: 125278 - DNA, 926 bp, Homo sapiens
  Payload ID: 4586
  Gene Symbol: DDX23
  Gene Name: DEAD (Asp-Glu-Ala-Asp) box polypeptide 23
  ENST ID: ENST00000552802
  CDS Start-End: 1-457
ggactacagcatcaccaccaaaggtggcaagatccccaatcccatccgatcctggaaagactcttctctgcccccacacatcttggaggtcattgataagtgtggctacaaggaaccaacacctatacagcgtcaggcaattcccattgggctacagaatcgtgacatcattggtgtggctgagactggcagtggcaagacagcagccttcctcatccctctgctggtctggatcaccacacttcccaaaattgacaggctggagtgcagtggtgtgatcttggcttacagcaaccgttgcctcccaggctcatatcctcctacctcagcctcccaagtagctgggattacaggatcgaagagtcagaccaaggcccttatgccatcatcctggctcccacccgtgagttggctcaacagattgaggaagagaccatcaagtttgggaaaccgctaggtatccgcactgtggctgtcattggtggcatctccagagaagaccagggcttcaggctgcgcatgggttgtgagattgtgattgctacccctgggcgtttgattgatgtgctggagaaccgctacctggtgctgagccgctgtacctatgtggttctggatgaggcagataggatgattgacatgggctttgagccagatgtccagaagatcctggagcacatgcctgtcagcaaccagaagccagacacggatgaggctgaggaccctgagaagatgctggccaactttgagtcgggaaaacataagtaccgccaaacagtcatgttcacggccaccatgcccccagcggtggagcgtctggccaggagctatcttcggcgacctgctgtggtgtacattggctccgcaggcaagccccatgagcgtgtggaacagaaggtcttcctcatgtcagagtcagaaaagag

SEQ ID NO: 125279 - DNA, 696 bp, Homo sapiens
  Payload ID: 4586
  Gene Symbol: DDX23
  Gene Name: DEAD (Asp-Glu-Ala-Asp) box polypeptide 23
  ENST ID: ENST00000552512
  CDS Start-End: 151-696
aaagatggcgacggctccgcgacgttgaggccgcgttgggcggttcagactcagggtgagatggggtttcaccgtgttggccaggatggtctcaatctcctgacctcatgatctgcccgctttggcctccaaaagtgctaggattacacgatggcaggagagctggctgacaaaaaggaccgtgatgcatcaccttccaaggaggaaaggaagcgatcacggactcctgacagagagcgggatagagaccgggaccggaagtcttccccatctaaagatagaaagcggcatcgttcaagggatagacgtcgaggaggcagccgttctcgctctcgttcccgttccaaatctgcagaaagagaacgacggcacaaagaacgagaacgagataaggagcgggatcggaataagaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcaggaggtggaa

SEQ ID NO: 125280 - DNA, 869 bp, Homo sapiens
  Payload ID: 4586
  Gene Symbol: DDX23
  Gene Name: DEAD (Asp-Glu-Ala-Asp) box polypeptide 23
  ENST ID: ENST00000550834
  CDS Start-End: 1-780
gctgaggctaagcccaagttcctctctaaagcagaacgagaggctgaagctctaaagcgacggcagcaggaggtggaagagcggcagaggatgcttgaagaagagaggaagaaaaggaaacagttccaagacttgggcaggaagatgttggaagatcctcaggaacgggaacgtcgggaacgcagggagaggatggaacgggagaccaatggaaatgaggatgaggaagggcggcagaagatccgggaagagaaggataagagcaaggaactgcatgccattaaggagcgttacctgggtggcatcaaaaagcggcgccgaacgagacatctcaatgaccggaaatttgtttttgagtgggatgcatctgaggacacatccattgactacaaccccctgtacaaagaacggcaccatcctcaccaagaagcgccgggaagagaccatctttgcctgacacagcactcttcctgtgggctgagggcatctccaaagctgcctgatgcctgtttttcagaaccctcacatccctctttccaggtcctcactcttgggatatgggggcttaggaaaacaatccaactccctagcccagaccctcaggtcaggaggcctgcgtgtggggctgcaaaaggagaggacgacgctgtcggaggcagggagagcaaattaccacagcttcttggcccagttctgcccttctttgctttgggattgcactgggccatcagctcatgccaggctatgggggcagccagttggcattgctccccagactgaacagaaacctggccgccggatgggacctcctttggcacagacttgactgtgtaactgcataaactgcagtagcatcattgccctagatg

SEQ ID NO: 125281 - DNA, 2643 bp, Homo sapiens
  Payload ID: 4587
  Gene Symbol: DDX27
  Gene Name: DEAD (Asp-Glu-Ala-Asp) box polypeptide 27
  Uniprot ID: Q96GQ7
  ENST ID: ENST00000371764
  CDS Start-End: 10-2400
aagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctcccttcctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaaccaa

SEQ ID NO: 125282 - DNA, 824 bp, Homo sapiens
  Payload ID: 4587
  Gene Symbol: DDX27
  Gene Name: DEAD (Asp-Glu-Ala-Asp) box polypeptide 27
  ENST ID: ENST00000462328
  CDS Start-End: 18-527
gtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcaggcaagttacttcaccatgctgccacaaagtgtcctcatctgtgaaacaaggttgacgatggtcacccctcagaggctgaagtgtggcattggcacttaggacagtgtccagcaggatgcaagtgctttgtaagtctgagccgtggtcatcagctaagtttttctccatagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccga

SEQ ID NO: 125283 - DNA, 2567 bp, Homo sapiens
  Payload ID: 4587
  Gene Symbol: DDX27
  Gene Name: DEAD (Asp-Glu-Ala-Asp) box polypeptide 27
  ENST ID: ENST00000618172
  CDS Start-End: 34-2331
gtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctcccttcctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagag

SEQ ID NO: 125284 - DNA, 825 bp, Homo sapiens
  Payload ID: 4587
  Gene Symbol: DDX27
  Gene Name: DEAD (Asp-Glu-Ala-Asp) box polypeptide 27
  ENST ID: ENST00000493252
  CDS Start-End: 1-825
aagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacagcccgcctgtcgacacagcctggccacacgcccccactttgtggcttctgcatttgccatttcctcagcctggagccatctcctgccccttcaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctccct

SEQ ID NO: 125285 - DNA, 2693 bp, Homo sapiens
  Payload ID: 4587
  Gene Symbol: DDX27
  Gene Name: DEAD (Asp-Glu-Ala-Asp) box polypeptide 27
  Uniprot ID: Q96GQ7
  ENST ID: ENST00000622530
  CDS Start-End: 62-2452
atgcgcactcttaagaggtcgaacggggagggcggcaggggctctggaacggaagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccattgtgctgggcagacgacaaaaagctttggggaagaaccgcagtgctgatttcaaccctgatttcgttttcactgagaaggaggggacgtacgatggcagctgggccctggctgatgtcatgagccaactcaagaagaagagggcagccactacattagatgagaagattgagaaagttcgaaagaaaaggaaaacagaggataaagaagccaagtctgggaagttggaaaaggagaaagaagcaaaggaaggctctgaaccaaaggagcaggaagaccttcaagagaatgatgaggaaggctcagaagatgaagcctcggagactgactactcatcagctgatgagaacatcctcaccaaagcagatacactcaaagtaaaggatcggaagaagaagaagaagaaaggacaggaagcaggaggattttttgaagatgcatctcagtacgatgaaaacctctcgttccaggacatgaacctttcccgccctcttctgaaggccattacagccatgggcttcaagcagcccaccccgatccagaaggcgtgcatacctgtgggtctattggggaaggacatctgtgcctgtgcagccactgggacaggtaaaactgccgcctttgccctgcctgttttggagcgtctgatttataaaccccgccaggctccagtcacccgcgtgctggtgctagtgcccacccgagagctgggcatccaggtgcactctgtcaccagacagctggcccagttctgcaacatcaccacctgcctggctgtgggcggcttggatgtgaagtctcaggaagcagctcttcgggcagcgcctgacatcctcatcgccaccccaggccggctcatcgatcacctccacaactgcccttccttccacctgagcagcatcgaggtgctcatcctggacgaggctgacaggatgctggatgagtactttgaggagcagatgaaggagatcatccgaatgtgttcccaccaccgccagaccatgctcttctcggccaccatgacagacgaggtgaaagatctggcttctgtctccttgaagaatcctgtccggatatttgtgaacagcaacacagatgtggctcccttcctgcggcaggagttcatccggatccggcctaatcgtgaaggagaccgggaagccatcgtggcagctttgttgacgaggaccttcactgaccatgtgatgctgttcacgcaaaccaagaagcaggcccaccgcatgcacatcctcctggggctcatggggctgcaggtgggtgagctccatggcaacttgtcacagacgcagcggctggaggccctccggcgttttaaggatgaacagattgacatcctcgtggccactgatgtggcagcccgtggacttgacattgagggggtcaaaacggtaatcaacttcacaatgcctaataccatcaaacattatgtccaccgggtggggcgaacagcacgtgctggcagggctgggcgctcagtctctctggtgggagaagatgagcggaagatgctgaaggagattgtaaaagctgccaaggcccctgtgaaggccaggatacttccccaagatgtcatcctcaaattccgggacaagattgagaaaatggagaaagatgtgtatgcagttctgcagctagaggcggaggaaaaagagatgcagcagtcagaagcccagatcaatacagcaaagcggctcctggagaaggggaaggaggcagtggtccaagagcccgagaggagctggttccagaccaaagaagagaggaagaaggagaaaattgccaaagctctgcaggaatttgacttggccttaagaggaaagaagaaaaggaagaagtttatgaaggatgccaaaaaaaagggggagatgacagcagaggaaaggtctcagtttgaaatcctcaaggcgcagatgtttgctgaacggctagcgaagaggaatcgcagagccaagcgggcccgagcaatgcccgaggaggagccagtgagaggtcctgccaagaagcaaaagcaggggaagaaatctgtatttgatgaagaactcaccaacacaagcaagaaggccctgaaacagtatcgagctggcccttcctttgaagaaaggaaacagttgggcttgccccaccagagacgaggaggaaactttaaatctaaatccagatacaagaggaggaagtagctgtcgtggcctgaagaaattcatgggggcagcccttaaatcccttccctgtgggaagtcatcctggctggtctgtcttttctccatttgtttaaaaaaaaaacaaaaacaaaaaacaacactttggtgtggtggtatggtacgtagctattttcctaagcatgtctgtcaatctcccttcttgctgattagctttcatatgactatattaaatggaagtatttttgggaaaagagaaacc

SEQ ID NO: 125286 - DNA, 2169 bp, Homo sapiens
  Payload ID: 4588
  Gene Symbol: DDX28
  Gene Name: DEAD (Asp-Glu-Ala-Asp) box polypeptide 28
  Uniprot ID: Q9NUL7
  ENST ID: ENST00000332395
  CDS Start-End: 241-1863
atcgccagcctccagtcctgcctccacgacgcgcccttccccaaggctggccgggtctggatgtcgccatcccctattcggagctacagacctcgcagctgaactcttaaaaagaacctcgcttcttcctcacggtgctccagctccacacaccgtactgagcctcgccagccaccgtacgcgaggtcgcggcgcgtccgtgacgtcactgatgtgcgcttctcccgcactaagggaaacatggctctaacgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaaggtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgaggtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgccctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcctcccctaagaataattagcaccggggcggaa

SEQ ID NO: 125287 - DNA, 2408 bp, Homo sapiens
  Payload ID: 4589
  Gene Symbol: DDX31
  Gene Name: DEAD (Asp-Glu-Ala-Asp) box polypeptide 31
  Uniprot ID: Q9H8H2
  ENST ID: ENST00000310532
  CDS Start-End: 153-1910
aaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacgtgaagaactcaccctaagccagaggaaaggaaccttgcttttaataccatcattatgttgacgagttgataagaagtaccaccgaatggccggaaaatggagtttctaagccacctgattttaaggctgacattaggttttctgttggtctccggtggctgtccttgattgtccctggatggagtgcagtcacctttttcccagaaaggaaagatacctgcagcccgccctgggcgccaactgtcccttggcatcctccttggctgtccggcgcgtgcatttctttttcagaagatgcacctaaatcacctgtgctgctttcctccaccttctccgtatttttttccgcttgaagcatactgttctgtctgtgcagttcttaatttcctctcctcctggggaatttccaccgtgccaggaggctaggagacaaaggagatacggctgtgaagagtcacaatgtcagttctgtgtcccaaataaatgtagactttcgtgctt

SEQ ID NO: 125288 - DNA, 3285 bp, Homo sapiens
  Payload ID: 4589
  Gene Symbol: DDX31
  Gene Name: DEAD (Asp-Glu-Ala-Asp) box polypeptide 31
  Uniprot ID: Q9H8H2
  ENST ID: ENST00000372153
  CDS Start-End: 153-2708
aaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagtacaacgctccatcttcacctgcagaatacatccaccggattggaagaaccgcccggattggctgccatgggagcagcctgctcattttggctccttcggaggcagaatatgtcaactcgttggcttctcacaaaatcaacgtttctgagattaagatggaagatattttgtgtgttctgacaagagatgattgttttaaagggaaacgatggggagcccagaaatcccatgctgttggcccccaggaaatccgagagcgagccacagtcttgcagacggtatttgaagattacgtgcactccagtgagaggagggtctcctgggcaaagaaagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacatcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggaggcttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcag

SEQ ID NO: 125289 - DNA, 4577 bp, Homo sapiens
  Payload ID: 4589
  Gene Symbol: DDX31
  Gene Name: DEAD (Asp-Glu-Ala-Asp) box polypeptide 31
  Uniprot ID: Q9H8H2
  ENST ID: ENST00000372159
  CDS Start-End: 153-2708
aaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagtacaacgctccatcttcacctgcagaatacatccaccggattggaagaaccgcccggattggctgccatgggagcagcctgctcattttggctccttcggaggcagaatatgtcaactcgttggcttctcacaaaatcaacgtttctgagattaagatggaagatattttgtgtgttctgacaagagatgattgttttaaagggaaacgatggggagcccagaaatcccatgctgttggcccccaggaaatccgagagcgagccacagtcttgcagacggtatttgaagattacgtgcactccagtgagaggagggtctcctgggcaaagaaagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacatcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggaggcttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaatatatttatcactaattattttcttaatgtaggaatgtaccgttaaaaaggaccaaaagtttttggtctgggtcaaaaaatacgaatgtgttctcaggctcgtggtccctcttattttcttctggaaacacgaggttgcatttacatgcattgctccctctttcatgtccactgaaaactcactctctcagggctaattgatttactgttggctttttattatttgcctttgaagtcaaaaggcaccagtatcccaagctttttttccctatcgaatcctgtcttgtcttcaagaaaggtctgggggtctttgtattgtgacccaggccacagctgcccgccccccgcccccgacccaccccgccctgcccctgcattgtgttttctgggaggtttgaaagaggccccctggagcatattgatttcccaataaatgtaagatttgggcacttgcagaggggtccagaagagaaagggttggaggcctccacacctgtgggcaccgctcctgtcctctccactgtgtcttgccttctcagtttccttctcctctgcagtgactgtgccgccctctgtggtctccccaggaccagtgttgaggcaccacttcagtagatccccccagatccttggaaggtctgagtggccacgagagggtggtgagagttggcaaggtgggccttcctgcagggaccacggggggtcagcatccttgcctccgttctagacacaggtgaatgtcagtgggcacccacactggcggagactccagtgtgagggcaaggaggagcctagtgagactggatcctctgcaggtggaaaaataggaccttctcagagttggctgtcacatacaaattaacagggactgtgggtgacgtttctaacaataataattaaaaaacaacaaccctgcagcacatgtcagcctggcgttgggcaagtctgccacctttcttttatttcgatgtgtaatggttcacatgatttggatgagaaaaggagggatcaaactttatagacaaaacccagctgtgtgaaaaacaggattaatgccagtgattggggatgatcaaagagaaaccttactttttctcccccagtactcattccactaaagggcgaattggcagagttcggcatccctggggggaaagagaagtgctagaatcatgcaacgtgtgagtgacgataattccaagatcaaaacttacacacttaatctgctaactcttatggtgagggtttcttgccatagatgctatgtgggtctgtttctaagtagaatcactatattaccccagttaataaagaaacatggatttagcagatttaaggttaatattgtttaaatttaaataaccttaaaataaatctctttctcttcta

SEQ ID NO: 125290 - DNA, 2814 bp, Homo sapiens
  Payload ID: 4589
  Gene Symbol: DDX31
  Gene Name: DEAD (Asp-Glu-Ala-Asp) box polypeptide 31
  ENST ID: ENST00000438527
  CDS Start-End: 94-2334
ggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacagcgcagtgatggcccctatgccctggtgctcgtgccaacgagagagctagctctacaaagctttgacactgtccagaaactgcttaagcctttcacctggattgtgcctggagtgttaatgggaggagagaagagaaaatcagaaaaggccagactccgcaaaggaataaatatccttatctcaactcctggacgcctggtggatcatataaaatccacaaagaacattcattttagtcggctgcggtggttggtgtttgatgaagcagacagaatcttggatttgggttttgaaaaggacatcacagtgatacttaatgctgtaaatgctgaatgccaaaaacgacagaatgtcttgctatcagcgacactcacagaaggtgtaacgcggctagctgatatcagtttgcatgatccagtcagtatttctgtcctggacaagagccatgaccagttgaacccaaaggacaaagcggtccaggaggtctgtcctccaccagctggcgacaagctggacagctttgcaataccagagagtctcaagcagcatgtgactgtggttcccagcaaactgaggcttgtctgcctagcggccttcatccttcagaaatgcaagtttgaggaagaccagaagatggttgtctttttctcaagttgcgagctggtggagttccactacagcctcttcctacagaccctgctgagcagctcaggggcgccggcatcagggcagttgccatctgcctccatgcgattaaaattcctacggctgcatggcggcatggagcaggaggaaagaacagcagtgtttcaggaattttcacattccagaagaggcgtccttctttgcacggatgttgcagctcggggcttagatctccctcaagtcacgtggattgttcagtacaacgctccatcttcacctgcagaatacatccaccggattggaagaaccgcccggattggctgccatgggagcagcctgctcattttggctccttcggaggcagaatatgtcaactcgttggcttctcacaaaatcaacgtttctgagattaagatggaagatattttgtgtgttctgacaagagatgattgttttaaagggaaacgatggggagcccagaaatcccatgctgttggcccccaggaaatccgagagcgagccacagtcttgcagacggtatttgaagattacgtgcactccagtgagaggagggtctcctgggcaaagaaagctctgcagtccttcatccaagcctacgccacctaccccagggagctgaagcacatcttccacgtccgatccctccaccttgggcatgtggcgaagagcttcggactaagagatgcccccaggaatcttagtgccttgactagaaagaagaggaaagcacacgtgaaaaggcctgaccttcataagaagacccagagtaaacacagcctcgctgaaatcctacgttcggaatactcaagcggcatggaggccgacatcgccaaggtcaaaaagcaaaacgcacctggagagcctggtggccggcccctgcagcacagtctgcagccgacaccctgctttggccgtgggaaaacattaaaatggagaaaaacccaaaaaggtgtacagcgggacagcaagacttcccagaaagtttaaaatctctctgggtcttcgagtggaacctggaagccccgggtggcagtggattgatgtccagttcttgtcagaggaggcttgtgaaaaataactgcgcctttgcctgaataccacgtccccaagaatcagaggggccacagcccttctcctccatgggaggccctggagcctgatagaaatcagtggtgtggggcactgtagagactagccagctcccgacggaaggggtctgtgtcttgtattgatcccatcagtgcccggcactcccttcacccaggtgctgacgtgccggggttgagctggcaccccgggatgtgatgtaagaacgccctgcgcgtcagcctggaacgggcttgattgctgcccttaactgtgttctgaagtttcacagcttggcttcagcctatcagcgcatacattggcatgaattttgtgaattagggtgttaaaaactggaattgaatttgtacaaaaagagaa

SEQ ID NO: 125291 - DNA, 1333 bp, Homo sapiens
  Payload ID: 4589
  Gene Symbol: DDX31
  Gene Name: DEAD (Asp-Glu-Ala-Asp) box polypeptide 31
  Uniprot ID: Q9H8H2
  ENST ID: ENST00000480876
  CDS Start-End: 153-1112
aaaaaggacagcgagcggggagccccgaggacccccttttccctgcccagggattgagctccagagcctgttagggagctacccagacaggctttagttcctaaagtgctgaggaaacgcacggggcggtaaaggggaggctcgtcggtgagatggcgccggatctcgcttctcagaggcattcagagagcttccccagcgtgaactctcggccgaatgtaattttgccaggccgcgagggacgcagagaggggctgccaccaggcgggggcacgcgcggtagtcttgtccctacccgcccggtgccgccgtccccggctcccctcgggacgagtccgtacagctggagccgttccggacccggaaggggcggtggcgcagggtcctcgcgcgtcccacgtggggtcccgggcccagcagtctgcgcaccgggctcgctgctgcaccacgcgtcacccacgcagaccatggcagccgccgacggttcgctcttcgacaaccccaggacgttctccagacgtcccccagcccaggcgagtcggcaagcaaaggctacgaaaagaaaataccaagcgtccagtgaggctcccccagcgaaacggaggaacgaaacttcatttctcccagccaagaaaactagtgttaaagaaactcagaggacttttaaggggaacgcacaaaaaatgttttctccaaagaagcattcggttagcacaagtgatagaaaccaggaggagagacagtgcattaagacttcatcactgtttaaaaacaaccctgacattccagaactccacagacctgtggtaaagcaggtgcaagaaaaagtgtttacttcagctgcttttcatgagctgggcctccacccacatttaatttccacaataaatacggtcttaaaaatgtctagtatgaccagtgttcagaagcaaagtattcctgtgttgctggaaggcagagatgctctcgtgagatcccagacgggctcaggtaaaactcttgcctattgcatccctgtggtccagtcccttcaagcaatggagtcaaaaatacaggtattactgttatccacattttacgaagaagaacagaggcttaggaaagttaaataaccaaggccatgcagcaagtaatggaggaactggatttctacctcagttctgtttggctgcagagaccaagctccttactcttgtgtgaagacttacagtgaaggttaattcctggctcctgtgctatgtaggggccatgcatctgtgtcttccacagtacctaacgtgggaccttttacagaatggtcactcaataaaggtgatttggttttgcagctatc

SEQ ID NO: 125292 - DNA, 1471 bp, Homo sapiens
  Payload ID: 4590
  Gene Symbol: DDX39A
  Gene Name: DEAD (Asp-Glu-Ala-Asp) box polypeptide 39A
  Uniprot ID: O00148
  ENST ID: ENST00000242776
  CDS Start-End: 103-1386
aagaggcaggaagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctaga

SEQ ID NO: 125293 - DNA, 1355 bp, Homo sapiens
  Payload ID: 4590
  Gene Symbol: DDX39A
  Gene Name: DEAD (Asp-Glu-Ala-Asp) box polypeptide 39A
  Uniprot ID: O00148
  ENST ID: ENST00000324340
  CDS Start-End: 65-1033
ggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccagcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaa

SEQ ID NO: 125294 - DNA, 922 bp, Homo sapiens
  Payload ID: 4590
  Gene Symbol: DDX39A
  Gene Name: DEAD (Asp-Glu-Ala-Asp) box polypeptide 39A
  Uniprot ID: O00148
  ENST ID: ENST00000454233
  CDS Start-End: 119-922
agcagcagcccgacgcaagaggcaggaagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatgtcctctgggaagtgtcgcacaaaggagtcgcccactggaaggttctgggcaggcgagatgcccagaggtga

SEQ ID NO: 125295 - DNA, 585 bp, Homo sapiens
  Payload ID: 4590
  Gene Symbol: DDX39A
  Gene Name: DEAD (Asp-Glu-Ala-Asp) box polypeptide 39A
  ENST ID: ENST00000586993
  CDS Start-End: 211-585
tgcgctaggggtgggccagccgttggcgcgcggtgctcggggctcggggcccgcttctcggaggggctgtcatggcctacggcgctccgagccccacttggagtctgtcagttcgtccgaatagaccccgcggcggcctggggccatttggagagggacgagggggttcaagtgattctcctgcctccaagtagctgggattacagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggcc

SEQ ID NO: 125296 - DNA, 484 bp, Homo sapiens
  Payload ID: 4590
  Gene Symbol: DDX39A
  Gene Name: DEAD (Asp-Glu-Ala-Asp) box polypeptide 39A
  ENST ID: ENST00000591275
  CDS Start-End: 160-484
gtgggccagccgttggcgcgcggtgctcggggctcggggcccgcttctcggaggggctgtcatggcctacggcgctccgagccccacttggagtctgtcagttcgtccgaatagaccccgcggcggcctggggccatttggagagggacgaggggcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctg

SEQ ID NO: 125297 - DNA, 565 bp, Homo sapiens
  Payload ID: 4590
  Gene Symbol: DDX39A
  Gene Name: DEAD (Asp-Glu-Ala-Asp) box polypeptide 39A
  ENST ID: ENST00000590239
  CDS Start-End: 174-565
ggtgctcggggctcggggcccgcttctcggaggggctgtcatggcctacggcgctccgagccccacttggagtctgtcagttcgtccgaatagaccccgcggcggcctggggccatttggagagggacgagggggcacttggtatgcattagattaataaagcaaagagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaagga

SEQ ID NO: 125298 - DNA, 563 bp, Homo sapiens
  Payload ID: 4590
  Gene Symbol: DDX39A
  Gene Name: DEAD (Asp-Glu-Ala-Asp) box polypeptide 39A
  ENST ID: ENST00000590696
  CDS Start-End: 287-563
cgttggcgcgcggtgctcggggctcggggcccgcttctcggaggggctgtcatggcctacggcgctccgagccccacttggagtctgtcagttcgtccgaatagaccccgcggcggcctggggccatttggagagggacgaggggggcagggctgactggaagcggtgctgttttagttggggctgtgaggaaatgcctttctggagcaaaggaggcccaaaagaagtgggggatttgtgacccttccaggcagcaggaacagcaagtgcaaaggtgctgagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgg

SEQ ID NO: 125299 - DNA, 566 bp, Homo sapiens
  Payload ID: 4590
  Gene Symbol: DDX39A
  Gene Name: DEAD (Asp-Glu-Ala-Asp) box polypeptide 39A
  ENST ID: ENST00000590315
  CDS Start-End: 1-566
cgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatct

SEQ ID NO: 125300 - DNA, 1478 bp, Homo sapiens
  Payload ID: 4590
  Gene Symbol: DDX39A
  Gene Name: DEAD (Asp-Glu-Ala-Asp) box polypeptide 39A
  Uniprot ID: O00148
  ENST ID: ENST00000588692
  CDS Start-End: 1-804
atggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatgtcctctgggaagtgtcgcacaaaggagtcgcccactggaaggttctgggcaggcgagatgcccagaggtgatccctgcccgcccctcccacctcccttcccacacagcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagag

SEQ ID NO: 125301 - DNA, 829 bp, Homo sapiens
  Payload ID: 4590
  Gene Symbol: DDX39A
  Gene Name: DEAD (Asp-Glu-Ala-Asp) box polypeptide 39A
  ENST ID: ENST00000589675
  CDS Start-End: 65-829
ggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgagggttctcgtccctcacgctctgcttctcctgcagtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggat

SEQ ID NO: 125302 - DNA, 823 bp, Homo sapiens
  Payload ID: 4590
  Gene Symbol: DDX39A
  Gene Name: DEAD (Asp-Glu-Ala-Asp) box polypeptide 39A
  ENST ID: ENST00000592927
  CDS Start-End: 1-291
gtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctgggctcccctccctgaagcgtggctcgaggcgcacgggcacggctgctccgcgccagcgtgtaagtggattgcagctcctcccgcgcctgcgctcgctggccaccccccagcccctcaggcaccaggactggccactcccgcggctcactctgccctcgtcacggtgccactggctccctggcacagacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcg

SEQ ID NO: 125303 - DNA, 1529 bp, Homo sapiens
  Payload ID: 4591
  Gene Symbol: DDX39B
  Gene Name: DEAD (Asp-Glu-Ala-Asp) box polypeptide 39B
  ENST ID: ENST00000376177
  CDS Start-End: 5-1282
agttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcggtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125304 - DNA, 2039 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000383508
  CDS Start-End: 538-1824
cagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125305 - DNA, 2133 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000396172
  CDS Start-End: 632-1918
ctcagctagggcctgccggttcctagtgcgtgcccagcagtcctcaggtcaccttcactaccgggccaaggaccccgtgggaactcgcagccttcgccacactcgttcctcgcgcatccatggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125306 - DNA, 1529 bp, Homo sapiens
  Payload ID: 4591
  Gene Symbol: DDX39B
  Gene Name: DEAD (Asp-Glu-Ala-Asp) box polypeptide 39B
  ENST ID: ENST00000400293
  CDS Start-End: 5-1282
agttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcggtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125307 - DNA, 2003 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000400295
  CDS Start-End: 502-1788
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125308 - DNA, 2133 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000400296
  CDS Start-End: 632-1918
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125309 - DNA, 561 bp, Homo sapiens
  Payload ID: 4591
  Gene Symbol: DDX39B
  Gene Name: DEAD (Asp-Glu-Ala-Asp) box polypeptide 39B
  ENST ID: ENST00000428107
  CDS Start-End: 1-561
actcagaggagagggacataggaaagccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctaca

SEQ ID NO: 125310 - DNA, 2133 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000453138
  CDS Start-End: 632-1918
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatattttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125311 - DNA, 561 bp, Homo sapiens; identical to SEQ ID NO: 125309
  Payload ID: 4591
  Gene Symbol: DDX39B
  Gene Name: DEAD (Asp-Glu-Ala-Asp) box polypeptide 39B
  ENST ID: ENST00000412386
  CDS Start-End: 1-561

SEQ ID NO: 125312 - DNA, 633 bp, Homo sapiens
  Payload ID: 4591
  Gene Symbol: DDX39B
  Gene Name: DEAD (Asp-Glu-Ala-Asp) box polypeptide 39B
  ENST ID: ENST00000428291
  CDS Start-End: 43-633
cgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtgtttttgtgacagtcacttccctagaggggataatgaagagctacatttaccatatgtctccgtctacttcctgcctaaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtc

SEQ ID NO: 125313 - DNA, 583 bp, Homo sapiens
  Payload ID: 4591
  Gene Symbol: DDX39B
  Gene Name: DEAD (Asp-Glu-Ala-Asp) box polypeptide 39B
  ENST ID: ENST00000455324
  CDS Start-End: 175-583
ttcgtcgctgttgctgccgccatacgcgctctccctgtttagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcaca

SEQ ID NO: 125314 - DNA, 2003 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000441425
  CDS Start-End: 502-1788
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatattttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125315 - DNA, 1529 bp, Homo sapiens; identical to SEQ ID NO: 125306
  Payload ID: 4591
  Gene Symbol: DDX39B
  Gene Name: DEAD (Asp-Glu-Ala-Asp) box polypeptide 39B
  ENST ID: ENST00000446341
  CDS Start-End: 5-1282

SEQ ID NO: 125316 - DNA, 932 bp, Homo sapiens
  Payload ID: 4591
  Gene Symbol: DDX39B
  Gene Name: DEAD (Asp-Glu-Ala-Asp) box polypeptide 39B
  ENST ID: ENST00000452908
  CDS Start-End: 238-932
cttcgctacaatccgtttccatctgcgcttctccgcacccatcccgtcacatgggttcctgatacccttttcacaggcgatggtctggtcgctggggcctagttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgag

SEQ ID NO: 125317 - DNA, 2133 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000415689
  CDS Start-End: 632-1918
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcacatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125318 - DNA, 659 bp, Homo sapiens
  Payload ID: 4591
  Gene Symbol: DDX39B
  Gene Name: DEAD (Asp-Glu-Ala-Asp) box polypeptide 39B
  ENST ID: ENST00000453799
  CDS Start-End: 373-659
cccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggcgctcggcgtcccttggtcttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagac

SEQ ID NO: 125319 - DNA, 561 bp, Homo sapiens; identical to SEQ ID NO: 125309
  Payload ID: 4591
  Gene Symbol: DDX39B
  Gene Name: DEAD (Asp-Glu-Ala-Asp) box polypeptide 39B
  ENST ID: ENST00000455400
  CDS Start-End: 1-561

SEQ ID NO: 125320 - DNA, 659 bp, Homo sapiens
  Payload ID: 4591
  Gene Symbol: DDX39B
  Gene Name: DEAD (Asp-Glu-Ala-Asp) box polypeptide 39B
  ENST ID: ENST00000457900
  CDS Start-End: 373-659
cccttttcacaggcgatggtctggtcgctggggcctagttggttcgctatttccttagcttgcatccctttcgagagcaaagagctcctgggggaaggaagggaagctaaggggggacccaatccaagatggtgtcctcggcgccattgtgttcgttttgctcccttcttccaatgggttcttctcatattggaggcctcagcatcaatgagaggcggtgctcggcgtcccttggtcttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagac

SEQ ID NO: 125321 - DNA, 2133 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000413678
  CDS Start-End: 632-1918
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggaggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125322 - DNA, 591 bp, Homo sapiens
  Payload ID: 4591
  Gene Symbol: DDX39B
  Gene Name: DEAD (Asp-Glu-Ala-Asp) box polypeptide 39B
  ENST ID: ENST00000411415
  CDS Start-End: 30-591
cattgtgttcgttttgctcccttcttccaatgggttcttctcatattggaggcctcagcatcaatgagaggcggtgctcggcgtcccttggtcttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaact

SEQ ID NO: 125323 - DNA, 583 bp, Homo sapiens
  Payload ID: 4591
  Gene Symbol: DDX39B
  Gene Name: DEAD (Asp-Glu-Ala-Asp) box polypeptide 39B
  ENST ID: ENST00000429022
  CDS Start-End: 175-583
ttcgtcgctgttgctgccgccatacgcgctctccctgtttagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcaca

SEQ ID NO: 125324 - DNA, 561 bp, Homo sapiens; identical to SEQ ID NO: 125309
  Payload ID: 4591
  Gene Symbol: DDX39B
  Gene Name: DEAD (Asp-Glu-Ala-Asp) box polypeptide 39B
  ENST ID: ENST00000422243
  CDS Start-End: 1-561

SEQ ID NO: 125325 - DNA, 817 bp, Homo sapiens
  Payload ID: 4591
  Gene Symbol: DDX39B
  Gene Name: DEAD (Asp-Glu-Ala-Asp) box polypeptide 39B
  ENST ID: ENST00000428098
  CDS Start-End: 104-817
accggaagtgaaggcagatttccctccttcgtcgctgttgctgccgccatacgcgctctccctgtttagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtc

SEQ ID NO: 125326 - DNA, 928 bp, Homo sapiens
  Payload ID: 4591
  Gene Symbol: DDX39B
  Gene Name: DEAD (Asp-Glu-Ala-Asp) box polypeptide 39B
  ENST ID: ENST00000420958
  CDS Start-End: 222-928
ccaagtgtttacgatacgattggtgtcattgtatgtttctccaaaaggagtctcaccttcgtagcgtaacagtgatgtgagaccacttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccg

SEQ ID NO: 125327 - DNA, 932 bp, Homo sapiens; identical to SEQ ID NO: 125316
  Payload ID: 4591
  Gene Symbol: DDX39B
  Gene Name: DEAD (Asp-Glu-Ala-Asp) box polypeptide 39B
  ENST ID: ENST00000451051
  CDS Start-End: 238-932

SEQ ID NO: 125328 - DNA, 914 bp, Homo sapiens
  Payload ID: 4591
  Gene Symbol: DDX39B
  Gene Name: DEAD (Asp-Glu-Ala-Asp) box polypeptide 39B
  ENST ID: ENST00000415390
  CDS Start-End: 178-914
ttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccagga

SEQ ID NO: 125329 - DNA, 659 bp, Homo sapiens; identical to SEQ ID NO: 125320
  Payload ID: 4591
  Gene Symbol: DDX39B
  Gene Name: DEAD (Asp-Glu-Ala-Asp) box polypeptide 39B
  ENST ID: ENST00000441901
  CDS Start-End: 373-659

SEQ ID NO: 125330 - DNA, 2039 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000412106
  CDS Start-End: 538-1824
cagcatcggccataacaacagaaatggccagtcagtcccaaggtatccagcagcttctgcaagctgagaagcgggcagctgagaaggtggcagatgccagaaagaggaaggcccggcgactgaagcaggcaaaggaggaggcacagatggaggtggagcaataccgcagagagcgagagcacgaattccagagcaagcagcaggcgacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcacatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125331 - DNA, 720 bp, Homo sapiens
  Payload ID: 4591
  Gene Symbol: DDX39B
  Gene Name: DEAD (Asp-Glu-Ala-Asp) box polypeptide 39B
  ENST ID: ENST00000456976
  CDS Start-End: 345-720
cgctgttgctgccgccatacgcgctctccctgtttagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttgg

SEQ ID NO: 125332 - DNA, 2039 bp, Homo sapiens; identical to SEQ ID NO: 125304
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000456666
  CDS Start-End: 538-1824

SEQ ID NO: 125333 - DNA, 1529 bp, Homo sapiens; identical to SEQ ID NO: 125306
  Payload ID: 4591
  Gene Symbol: DDX39B
  Gene Name: DEAD (Asp-Glu-Ala-Asp) box polypeptide 39B
  ENST ID: ENST00000430703
  CDS Start-End: 5-1282

SEQ ID NO: 125334 - DNA, 406 bp, Homo sapiens
  Payload ID: 4591
  Gene Symbol: DDX39B
  Gene Name: DEAD (Asp-Glu-Ala-Asp) box polypeptide 39B
  ENST ID: ENST00000427927
  CDS Start-End: 1-406
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccg

SEQ ID NO: 125335 - DNA, 720 bp, Homo sapiens
  Payload ID: 4591
  Gene Symbol: DDX39B
  Gene Name: DEAD (Asp-Glu-Ala-Asp) box polypeptide 39B
  ENST ID: ENST00000414881
  CDS Start-End: 345-720
cgctgttgctgccgccatacgcgctctccctgtttagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttgg

SEQ ID NO: 125336 - DNA, 817 bp, Homo sapiens
  Payload ID: 4591
  Gene Symbol: DDX39B
  Gene Name: DEAD (Asp-Glu-Ala-Asp) box polypeptide 39B
  ENST ID: ENST00000449100
  CDS Start-End: 104-817
accggaagtgaaggcagatttccctccttcgtcgctgttgctgccgccatacgcgctctccctgtttagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtc

SEQ ID NO: 125337 - DNA, 583 bp, Homo sapiens
  Payload ID: 4591
  Gene Symbol: DDX39B
  Gene Name: DEAD (Asp-Glu-Ala-Asp) box polypeptide 39B
  ENST ID: ENST00000452163
  CDS Start-End: 187-583
agatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtgtttttgtgacagtcacttccctagaggggataatgaagagctacatttaccat

SEQ ID NO: 125338 - DNA, 817 bp, Homo sapiens; identical to SEQ ID NO: 125336
  Payload ID: 4591
  Gene Symbol: DDX39B
  Gene Name: DEAD (Asp-Glu-Ala-Asp) box polypeptide 39B
  ENST ID: ENST00000446272
  CDS Start-End: 104-817

SEQ ID NO: 125339 - DNA, 1005 bp, Homo sapiens
  Payload ID: 4591
  Gene Symbol: DDX39B
  Gene Name: DEAD (Asp-Glu-Ala-Asp) box polypeptide 39B
  ENST ID: ENST00000439927
  CDS Start-End: 139-1005
ttggatttttctcaccttgacttgcccaacttaatttggagtgccttccaagtgtttacgatacgattggtgtcattgtatgtttctccaaaaggagtctcaccttcgtagcgtaacagtgatgtgagaccacttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 125340 - DNA, 561 bp, Homo sapiens; identical to SEQ ID NO: 125309
  Payload ID: 4591
  Gene Symbol: DDX39B
  Gene Name: DEAD (Asp-Glu-Ala-Asp) box polypeptide 39B
  ENST ID: ENST00000417995
  CDS Start-End: 1-561

SEQ ID NO: 125341 - DNA, 566 bp, Homo sapiens
  Payload ID: 4591
  Gene Symbol: DDX39B
  Gene Name: DEAD (Asp-Glu-Ala-Asp) box polypeptide 39B
  ENST ID: ENST00000416325
  CDS Start-End: 1-566
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 125342 - DNA, 928 bp, Homo sapiens
  Payload ID: 4591
  Gene Symbol: DDX39B
  Gene Name: DEAD (Asp-Glu-Ala-Asp) box polypeptide 39B
  ENST ID: ENST00000436995
  CDS Start-End: 222-928
ccaagtgtttacgatacgattggtgtcattgtatgtttctccaaaaggagtctcaccttcgtagcgtaacagtgatgtgagaccacttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccg

SEQ ID NO: 125343 - DNA, 63 bp, Homo sapiens
  Payload ID: 4591
  Gene Symbol: DDX39B
  Gene Name: DEAD (Asp-Glu-Ala-Asp) box polypeptide 39B
  ENST ID: ENST00000434740
  CDS Start-End: 1-63
tggccacactgcaacagctggagccagttactgggcaggtgtctgtactggtgatgtgtcaca

SEQ ID NO: 125344 - DNA, 591 bp, Homo sapiens; identical to SEQ ID NO: 125322
  Payload ID: 4591
  Gene Symbol: DDX39B
  Gene Name: DEAD (Asp-Glu-Ala-Asp) box polypeptide 39B
  ENST ID: ENST00000445783
  CDS Start-End: 30-591

SEQ ID NO: 125345 - DNA, 817 bp, Homo sapiens; identical to SEQ ID NO: 125325
  Payload ID: 4591
  Gene Symbol: DDX39B
  Gene Name: DEAD (Asp-Glu-Ala-Asp) box polypeptide 39B
  ENST ID: ENST00000444726
  CDS Start-End: 104-817

SEQ ID NO: 125346 - DNA, 75 bp, Homo sapiens
  Payload ID: 4591
  Gene Symbol: DDX39B
  Gene Name: DEAD (Asp-Glu-Ala-Asp) box polypeptide 39B
  ENST ID: ENST00000433987
  CDS Start-End: 1-75
tggccacactgcaacagctggagccagttactgggcaggtgtctgtactggtgatgtgtcacactcgggagttgg

SEQ ID NO: 125347 - DNA, 561 bp, Homo sapiens; identical to SEQ ID NO: 125309
  Payload ID: 4591
  Gene Symbol: DDX39B
  Gene Name: DEAD (Asp-Glu-Ala-Asp) box polypeptide 39B
  ENST ID: ENST00000433293
  CDS Start-End: 1-561

SEQ ID NO: 125348 - DNA, 583 bp, Homo sapiens; identical to SEQ ID NO: 125337
  Payload ID: 4591
  Gene Symbol: DDX39B
  Gene Name: DEAD (Asp-Glu-Ala-Asp) box polypeptide 39B
  ENST ID: ENST00000439857
  CDS Start-End: 187-583

SEQ ID NO: 125349 - DNA, 583 bp, Homo sapiens; identical to SEQ ID NO: 125323
  Payload ID: 4591
  Gene Symbol: DDX39B
  Gene Name: DEAD (Asp-Glu-Ala-Asp) box polypeptide 39B
  ENST ID: ENST00000415515
  CDS Start-End: 175-583

SEQ ID NO: 125350 - DNA, 2003 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000412330
  CDS Start-End: 502-1788
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtggggggcagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125351 - DNA, 914 bp, Homo sapiens; identical to SEQ ID NO: 125328
  Payload ID: 4591
  Gene Symbol: DDX39B
  Gene Name: DEAD (Asp-Glu-Ala-Asp) box polypeptide 39B
  ENST ID: ENST00000452792
  CDS Start-End: 178-914

SEQ ID NO: 125352 - DNA, 2133 bp, Homo sapiens; identical to SEQ ID NO: 125305
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000430784
  CDS Start-End: 632-1918

SEQ ID NO: 125353 - DNA, 1005 bp, Homo sapiens; identical to SEQ ID NO: 125339
  Payload ID: 4591
  Gene Symbol: DDX39B
  Gene Name: DEAD (Asp-Glu-Ala-Asp) box polypeptide 39B
  ENST ID: ENST00000427214
  CDS Start-End: 139-1005

SEQ ID NO: 125354 - DNA, 1201 bp, Homo sapiens
  Payload ID: 4591
  Gene Symbol: DDX39B
  Gene Name: DEAD (Asp-Glu-Ala-Asp) box polypeptide 39B
  ENST ID: ENST00000420337
  CDS Start-End: 1-986
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125355 - DNA, 928 bp, Homo sapiens; identical to SEQ ID NO: 125326
  Payload ID: 4591
  Gene Symbol: DDX39B
  Gene Name: DEAD (Asp-Glu-Ala-Asp) box polypeptide 39B
  ENST ID: ENST00000436919
  CDS Start-End: 222-928

SEQ ID NO: 125356 - DNA, 583 bp, Homo sapiens; identical to SEQ ID NO: 125313
  Payload ID: 4591
  Gene Symbol: DDX39B
  Gene Name: DEAD (Asp-Glu-Ala-Asp) box polypeptide 39B
  ENST ID: ENST00000418897
  CDS Start-End: 175-583

SEQ ID NO: 125357 - DNA, 2003 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000456476
  CDS Start-End: 502-1788
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcacatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125358 - DNA, 720 bp, Homo sapiens; identical to SEQ ID NO: 125335
  Payload ID: 4591
  Gene Symbol: DDX39B
  Gene Name: DEAD (Asp-Glu-Ala-Asp) box polypeptide 39B
  ENST ID: ENST00000412246
  CDS Start-End: 345-720

SEQ ID NO: 125359 - DNA, 583 bp, Homo sapiens
  Payload ID: 4591
  Gene Symbol: DDX39B
  Gene Name: DEAD (Asp-Glu-Ala-Asp) box polypeptide 39B
  ENST ID: ENST00000415036
  CDS Start-End: 187-583
acatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtgtttttgtgacagtcacttccctagaggggataatgaagagctacatttaccat

SEQ ID NO: 125360 - DNA, 720 bp, Homo sapiens; identical to SEQ ID NO: 125335
  Payload ID: 4591
  Gene Symbol: DDX39B
  Gene Name: DEAD (Asp-Glu-Ala-Asp) box polypeptide 39B
  ENST ID: ENST00000413544
  CDS Start-End: 345-720

SEQ ID NO: 125361 - DNA, 817 bp, Homo sapiens; identical to SEQ ID NO: 125336
  Payload ID: 4591
  Gene Symbol: DDX39B
  Gene Name: DEAD (Asp-Glu-Ala-Asp) box polypeptide 39B
  ENST ID: ENST00000438301
  CDS Start-End: 104-817

SEQ ID NO: 125362 - DNA, 659 bp, Homo sapiens; identical to SEQ ID NO: 125320
  Payload ID: 4591
  Gene Symbol: DDX39B
  Gene Name: DEAD (Asp-Glu-Ala-Asp) box polypeptide 39B
  ENST ID: ENST00000414451
  CDS Start-End: 373-659

SEQ ID NO: 125363 - DNA, 1529 bp, Homo sapiens; identical to SEQ ID NO: 125306
  Payload ID: 4591
  Gene Symbol: DDX39B
  Gene Name: DEAD (Asp-Glu-Ala-Asp) box polypeptide 39B
  ENST ID: ENST00000438578
  CDS Start-End: 5-1282

SEQ ID NO: 125364 - DNA, 2003 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000431360
  CDS Start-End: 502-1788
ctcagctagggcctgccggttcctagtgcgtgcccagcagtcctcaggtcaccttcactaccgggccaaggaccccgtgggaactcgcagccttcgccacactcgttcctcgcgcatccatggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125365 - DNA, 932 bp, Homo sapiens
  Payload ID: 4591
  Gene Symbol: DDX39B
  Gene Name: DEAD (Asp-Glu-Ala-Asp) box polypeptide 39B
  ENST ID: ENST00000444267
  CDS Start-End: 238-932
cttcgctacaatccgtttccatctgcgcttctccgcacccatcccgtcacatgggttcctgatacccttttcacaggcgatggtctggtcgctggggcctagttgctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgag

SEQ ID NO: 125366 - DNA, 583 bp, Homo sapiens; identical to SEQ ID NO: 125337
  Payload ID: 4591
  Gene Symbol: DDX39B
  Gene Name: DEAD (Asp-Glu-Ala-Asp) box polypeptide 39B
  ENST ID: ENST00000419020
  CDS Start-End: 187-583

SEQ ID NO: 125367 - DNA, 720 bp, Homo sapiens; identical to SEQ ID NO: 125335
  Payload ID: 4591
  Gene Symbol: DDX39B
  Gene Name: DEAD (Asp-Glu-Ala-Asp) box polypeptide 39B
  ENST ID: ENST00000423951
  CDS Start-End: 345-720

SEQ ID NO: 125368 - DNA, 720 bp, Homo sapiens; identical to SEQ ID NO: 125331
  Payload ID: 4591
  Gene Symbol: DDX39B
  Gene Name: DEAD (Asp-Glu-Ala-Asp) box polypeptide 39B
  ENST ID: ENST00000419913
  CDS Start-End: 345-720

SEQ ID NO: 125369 - DNA, 817 bp, Homo sapiens
  Payload ID: 4591
  Gene Symbol: DDX39B
  Gene Name: DEAD (Asp-Glu-Ala-Asp) box polypeptide 39B
  ENST ID: ENST00000455645
  CDS Start-End: 104-817
accggaagtgaaggcacatttccctccttcgtcgctgttgctgccgccatacgcgctctccctgtttagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtc

SEQ ID NO: 125370 - DNA, 2133 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000448296
  CDS Start-End: 632-1918
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtggggggcagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125371 - DNA, 413 bp, Homo sapiens
  Payload ID: 4591
  Gene Symbol: DDX39B
  Gene Name: DEAD (Asp-Glu-Ala-Asp) box polypeptide 39B
  ENST ID: ENST00000455806
  CDS Start-End: 1-413
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtc

SEQ ID NO: 125372 - DNA, 633 bp, Homo sapiens; identical to SEQ ID NO: 125312
  Payload ID: 4591
  Gene Symbol: DDX39B
  Gene Name: DEAD (Asp-Glu-Ala-Asp) box polypeptide 39B
  ENST ID: ENST00000428450
  CDS Start-End: 43-633

SEQ ID NO: 125373 - DNA, 633 bp, Homo sapiens
  Payload ID: 4591
  Gene Symbol: DDX39B
  Gene Name: DEAD (Asp-Glu-Ala-Asp) box polypeptide 39B
  ENST ID: ENST00000416183
  CDS Start-End: 43-633
cgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtgtttttgtgacagtcacttccctagaggggataatgaagagctacatttaccatatgtctccgtatacttcctgcctaaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtc

SEQ ID NO: 125374 - DNA, 583 bp, Homo sapiens; identical to SEQ ID NO: 125337
  Payload ID: 4591
  Gene Symbol: DDX39B
  Gene Name: DEAD (Asp-Glu-Ala-Asp) box polypeptide 39B
  ENST ID: ENST00000449010
  CDS Start-End: 187-583

SEQ ID NO: 125375 - DNA, 192 bp, Homo sapiens
  Payload ID: 4591
  Gene Symbol: DDX39B
  Gene Name: DEAD (Asp-Glu-Ala-Asp) box polypeptide 39B
  ENST ID: ENST00000433789
  CDS Start-End: 1-192
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaact

SEQ ID NO: 125376 - DNA, 1005 bp, Homo sapiens
  Payload ID: 4591
  Gene Symbol: DDX39B
  Gene Name: DEAD (Asp-Glu-Ala-Asp) box polypeptide 39B
  ENST ID: ENST00000435182
  CDS Start-End: 139-1005
ttggatttttctcaccttgacttgcccaacttaatttggagtgccttccaagtgtttacgatacgattggtgtcattgtatgtttctccaaaaggagtctcaccttcgtagcgtaacagtgatgtgagaccacttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 125377 - DNA, 817 bp, Homo sapiens; identical to SEQ ID NO: 125336
  Payload ID: 4591
  Gene Symbol: DDX39B
  Gene Name: DEAD (Asp-Glu-Ala-Asp) box polypeptide 39B
  ENST ID: ENST00000438433
  CDS Start-End: 104-817

SEQ ID NO: 125378 - DNA, 1201 bp, Homo sapiens; identical to SEQ ID NO: 125354
  Payload ID: 4591
  Gene Symbol: DDX39B
  Gene Name: DEAD (Asp-Glu-Ala-Asp) box polypeptide 39B
  ENST ID: ENST00000426766
  CDS Start-End: 1-986

SEQ ID NO: 125379 - DNA, 561 bp, Homo sapiens; identical to SEQ ID NO: 125309
  Payload ID: 4591
  Gene Symbol: DDX39B
  Gene Name: DEAD (Asp-Glu-Ala-Asp) box polypeptide 39B
  ENST ID: ENST00000417023
  CDS Start-End: 1-561

SEQ ID NO: 125380 - DNA, 932 bp, Homo sapiens; identical to SEQ ID NO: 125316
  Payload ID: 4591
  Gene Symbol: DDX39B
  Gene Name: DEAD (Asp-Glu-Ala-Asp) box polypeptide 39B
  ENST ID: ENST00000444480
  CDS Start-End: 238-932

SEQ ID NO: 125381 - DNA, 394 bp, Homo sapiens
  Payload ID: 4591
  Gene Symbol: DDX39B
  Gene Name: DEAD (Asp-Glu-Ala-Asp) box polypeptide 39B
  ENST ID: ENST00000427652
  CDS Start-End: 1-394
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgag

SEQ ID NO: 125382 - DNA, 1005 bp, Homo sapiens; identical to SEQ ID NO: 125376
  Payload ID: 4591
  Gene Symbol: DDX39B
  Gene Name: DEAD (Asp-Glu-Ala-Asp) box polypeptide 39B
  ENST ID: ENST00000414088
  CDS Start-End: 139-1005

SEQ ID NO: 125383 - DNA, 2003 bp, Homo sapiens
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000416863
  CDS Start-End: 502-1788
ctcagctagggcctgccggttcctagtgcgtgcccagcagtcctcaggtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggaggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125384 - DNA, 1529 bp, Homo sapiens; identical to SEQ ID NO: 125306
  Payload ID: 4591
  Gene Symbol: DDX39B
  Gene Name: DEAD (Asp-Glu-Ala-Asp) box polypeptide 39B
  ENST ID: ENST00000453488
  CDS Start-End: 5-1282

SEQ ID NO: 125385 - DNA, 591 bp, Homo sapiens; identical to SEQ ID NO: 125322
  Payload ID: 4591
  Gene Symbol: DDX39B
  Gene Name: DEAD (Asp-Glu-Ala-Asp) box polypeptide 39B
  ENST ID: ENST00000441479
  CDS Start-End: 30-591

SEQ ID NO: 125386 - DNA, 1529 bp, Homo sapiens; identical to SEQ ID NO: 125303
  Payload ID: 4591
  Gene Symbol: DDX39B
  Gene Name: DEAD (Asp-Glu-Ala-Asp) box polypeptide 39B
  ENST ID: ENST00000450987
  CDS Start-End: 5-1282

SEQ ID NO: 125387 - DNA, 914 bp, Homo sapiens; identical to SEQ ID NO: 125328
  Payload ID: 4591
  Gene Symbol: DDX39B
  Gene Name: DEAD (Asp-Glu-Ala-Asp) box polypeptide 39B
  ENST ID: ENST00000431908
  CDS Start-End: 178-914

SEQ ID NO: 125388 - DNA, 583 bp, Homo sapiens; identical to SEQ ID NO: 125337
  Payload ID: 4591
  Gene Symbol: DDX39B
  Gene Name: DEAD (Asp-Glu-Ala-Asp) box polypeptide 39B
  ENST ID: ENST00000417491
  CDS Start-End: 187-583

SEQ ID NO: 125389 - DNA, 633 bp, Homo sapiens; identical to SEQ ID NO: 125373
  Payload ID: 4591
  Gene Symbol: DDX39B
  Gene Name: DEAD (Asp-Glu-Ala-Asp) box polypeptide 39B
  ENST ID: ENST00000433291
  CDS Start-End: 43-633

SEQ ID NO: 125390 - DNA, 633 bp, Homo sapiens; identical to SEQ ID NO: 125373
  Payload ID: 4591
  Gene Symbol: DDX39B
  Gene Name: DEAD (Asp-Glu-Ala-Asp) box polypeptide 39B
  ENST ID: ENST00000432433
  CDS Start-End: 43-633

SEQ ID NO: 125391 - DNA, 290 bp, Homo sapiens
  Payload ID: 4591
  Gene Symbol: DDX39B
  Gene Name: DEAD (Asp-Glu-Ala-Asp) box polypeptide 39B
  ENST ID: ENST00000457121
  CDS Start-End: 1-290
tggccacactgcaacagctggagccagttactgggcaggtgtgtttttgtgacagtcacttccctagaggggataatgaagagctacatttaccatatgtctccgtctacttcctgcctaaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtc

SEQ ID NO: 125392 - DNA, 591 bp, Homo sapiens; identical to SEQ ID NO: 125322
  Payload ID: 4591
  Gene Symbol: DDX39B
  Gene Name: DEAD (Asp-Glu-Ala-Asp) box polypeptide 39B
  ENST ID: ENST00000439691
  CDS Start-End: 30-591

SEQ ID NO: 125393 - DNA, 633 bp, Homo sapiens; identical to SEQ ID NO: 125373
  Payload ID: 4591
  Gene Symbol: DDX39B
  Gene Name: DEAD (Asp-Glu-Ala-Asp) box polypeptide 39B
  ENST ID: ENST00000442717
  CDS Start-End: 43-633

SEQ ID NO: 125394 - DNA, 928 bp, Homo sapiens; identical to SEQ ID NO: 125326
  Payload ID: 4591
  Gene Symbol: DDX39B
  Gene Name: DEAD (Asp-Glu-Ala-Asp) box polypeptide 39B
  ENST ID: ENST00000449863
  CDS Start-End: 222-928

SEQ ID NO: 125395 - DNA, 591 bp, Homo sapiens
  Payload ID: 4591
  Gene Symbol: DDX39B
  Gene Name: DEAD (Asp-Glu-Ala-Asp) box polypeptide 39B
  ENST ID: ENST00000449757
  CDS Start-End: 30-591
cattgtgttcgttttgctcccttcttccaatgggttcttctcatattggaggcctcagcatcaatgagaggcggcgctcggcgtcccttggtcttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaact

SEQ ID NO: 125396 - DNA, 583 bp, Homo sapiens; identical to SEQ ID NO: 125323
  Payload ID: 4591
  Gene Symbol: DDX39B
  Gene Name: DEAD (Asp-Glu-Ala-Asp) box polypeptide 39B
  ENST ID: ENST00000438883
  CDS Start-End: 175-583

SEQ ID NO: 125397 - DNA, 96 bp, Homo sapiens
  Payload ID: 4591
  Gene Symbol: DDX39B
  Gene Name: DEAD (Asp-Glu-Ala-Asp) box polypeptide 39B
  ENST ID: ENST00000451465
  CDS Start-End: 1-96
tggccacactgcaacagctggagccagttactgggcaggtgtgtttttgtgacagtcacttccctagaggggataatgaagagctacatttaccat

SEQ ID NO: 125398 - DNA, 633 bp, Homo sapiens; identical to SEQ ID NO: 125373
  Payload ID: 4591
  Gene Symbol: DDX39B
  Gene Name: DEAD (Asp-Glu-Ala-Asp) box polypeptide 39B
  ENST ID: ENST00000432466
  CDS Start-End: 43-633

SEQ ID NO: 125399 - DNA, 720 bp, Homo sapiens; identical to SEQ ID NO: 125335
  Payload ID: 4591
  Gene Symbol: DDX39B
  Gene Name: DEAD (Asp-Glu-Ala-Asp) box polypeptide 39B
  ENST ID: ENST00000426189
  CDS Start-End: 345-720

SEQ ID NO: 125400 - DNA, 561 bp, Homo sapiens; identical to SEQ ID NO: 125309
  Payload ID: 4591
  Gene Symbol: DDX39B
  Gene Name: DEAD (Asp-Glu-Ala-Asp) box polypeptide 39B
  ENST ID: ENST00000445602
  CDS Start-End: 1-561

SEQ ID NO: 125401 - DNA, 1005 bp, Homo sapiens; identical to SEQ ID NO: 125376
  Payload ID: 4591
  Gene Symbol: DDX39B
  Gene Name: DEAD (Asp-Glu-Ala-Asp) box polypeptide 39B
  ENST ID: ENST00000417558
  CDS Start-End: 139-1005

SEQ ID NO: 125402 - DNA, 928 bp, Homo sapiens; identical to SEQ ID NO: 125342
  Payload ID: 4591
  Gene Symbol: DDX39B
  Gene Name: DEAD (Asp-Glu-Ala-Asp) box polypeptide 39B
  ENST ID: ENST00000419338
  CDS Start-End: 222-928

SEQ ID NO: 125403 - DNA, 914 bp, Homo sapiens; identical to SEQ ID NO: 125328
  Payload ID: 4591
  Gene Symbol: DDX39B
  Gene Name: DEAD (Asp-Glu-Ala-Asp) box polypeptide 39B
  ENST ID: ENST00000427489
  CDS Start-End: 178-914

SEQ ID NO: 125404 - DNA, 2039 bp, Homo sapiens; identical to SEQ ID NO: 125304
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000445218
  CDS Start-End: 538-1824

SEQ ID NO: 125405 - DNA, 583 bp, Homo sapiens; identical to SEQ ID NO: 125337
  Payload ID: 4591
  Gene Symbol: DDX39B
  Gene Name: DEAD (Asp-Glu-Ala-Asp) box polypeptide 39B
  ENST ID: ENST00000452414
  CDS Start-End: 187-583

SEQ ID NO: 125406 - DNA, 591 bp, Homo sapiens; identical to SEQ ID NO: 125322
  Payload ID: 4591
  Gene Symbol: DDX39B
  Gene Name: DEAD (Asp-Glu-Ala-Asp) box polypeptide 39B
  ENST ID: ENST00000442537
  CDS Start-End: 30-591

SEQ ID NO: 125407 - DNA, 932 bp, Homo sapiens; identical to SEQ ID NO: 125316
  Payload ID: 4591
  Gene Symbol: DDX39B
  Gene Name: DEAD (Asp-Glu-Ala-Asp) box polypeptide 39B
  ENST ID: ENST00000415027
  CDS Start-End: 238-932

SEQ ID NO: 125408 - DNA, 2039 bp, Homo sapiens; identical to SEQ ID NO: 125304
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000414440
  CDS Start-End: 538-1824

SEQ ID NO: 125409 - DNA, 659 bp, Homo sapiens; identical to SEQ ID NO: 125320
  Payload ID: 4591
  Gene Symbol: DDX39B
  Gene Name: DEAD (Asp-Glu-Ala-Asp) box polypeptide 39B
  ENST ID: ENST00000425047
  CDS Start-End: 373-659

SEQ ID NO: 125410 - DNA, 914 bp, Homo sapiens; identical to SEQ ID NO: 125328
  Payload ID: 4591
  Gene Symbol: DDX39B
  Gene Name: DEAD (Asp-Glu-Ala-Asp) box polypeptide 39B
  ENST ID: ENST00000448000
  CDS Start-End: 178-914

SEQ ID NO: 125411 - DNA, 914 bp, Homo sapiens; identical to SEQ ID NO: 125328
  Payload ID: 4591
  Gene Symbol: DDX39B
  Gene Name: DEAD (Asp-Glu-Ala-Asp) box polypeptide 39B
  ENST ID: ENST00000427425
  CDS Start-End: 178-914

SEQ ID NO: 125412 - DNA, 1201 bp, Homo sapiens; identical to SEQ ID NO: 125354
  Payload ID: 4591
  Gene Symbol: DDX39B
  Gene Name: DEAD (Asp-Glu-Ala-Asp) box polypeptide 39B
  ENST ID: ENST00000448800
  CDS Start-End: 1-986

SEQ ID NO: 125413 - DNA, 591 bp, Homo sapiens; identical to SEQ ID NO: 125395
  Payload ID: 4591
  Gene Symbol: DDX39B
  Gene Name: DEAD (Asp-Glu-Ala-Asp) box polypeptide 39B
  ENST ID: ENST00000417136
  CDS Start-End: 30-591

SEQ ID NO: 125414 - DNA, 1005 bp, Homo sapiens; identical to SEQ ID NO: 125376
  Payload ID: 4591
  Gene Symbol: DDX39B
  Gene Name: DEAD (Asp-Glu-Ala-Asp) box polypeptide 39B
  ENST ID: ENST00000455916
  CDS Start-End: 139-1005

SEQ ID NO: 125415 - DNA, 928 bp, Homo sapiens; identical to SEQ ID NO: 125326
  Payload ID: 4591
  Gene Symbol: DDX39B
  Gene Name: DEAD (Asp-Glu-Ala-Asp) box polypeptide 39B
  ENST ID: ENST00000416969
  CDS Start-End: 222-928

SEQ ID NO: 125416 - DNA, 659 bp, Homo sapiens; identical to SEQ ID NO: 125320
  Payload ID: 4591
  Gene Symbol: DDX39B
  Gene Name: DEAD (Asp-Glu-Ala-Asp) box polypeptide 39B
  ENST ID: ENST00000443933
  CDS Start-End: 373-659

SEQ ID NO: 125417 - DNA, 1005 bp, Homo sapiens
  Payload ID: 4591
  Gene Symbol: DDX39B
  Gene Name: DEAD (Asp-Glu-Ala-Asp) box polypeptide 39B
  ENST ID: ENST00000438449
  CDS Start-End: 139-1005
ttggatttttctcaccttgacttggccaacttaatttggagtgccttccaagtgtttacgatacgattggtgtcattgtatgtttctccaaaaggagtctcaccttcgtagcgtaacagtgatgtgagaccacttgttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 125418 - DNA, 583 bp, Homo sapiens; identical to SEQ ID NO: 125323
  Payload ID: 4591
  Gene Symbol: DDX39B
  Gene Name: DEAD (Asp-Glu-Ala-Asp) box polypeptide 39B
  ENST ID: ENST00000448658
  CDS Start-End: 175-583

SEQ ID NO: 125419 - DNA, 914 bp, Homo sapiens; identical to SEQ ID NO: 125328
  Payload ID: 4591
  Gene Symbol: DDX39B
  Gene Name: DEAD (Asp-Glu-Ala-Asp) box polypeptide 39B
  ENST ID: ENST00000446328
  CDS Start-End: 178-914

SEQ ID NO: 125420 - DNA, 932 bp, Homo sapiens; identical to SEQ ID NO: 125316
  Payload ID: 4591
  Gene Symbol: DDX39B
  Gene Name: DEAD (Asp-Glu-Ala-Asp) box polypeptide 39B
  ENST ID: ENST00000432189
  CDS Start-End: 238-932

SEQ ID NO: 125421 - DNA, 1224 bp, Homo sapiens
  Payload ID: 4591
  Gene Symbol: DDX39B
  Gene Name: DEAD (Asp-Glu-Ala-Asp) box polypeptide 39B
  ENST ID: ENST00000437943
  CDS Start-End: 1-977
tggccacactgcaacagctggagccagttactgggcaggtgtctgtactggtgatgtgtcacactcgggagttggcttttcagatcagcaaggaatatgagcgcttctctaaatacatgcccaatgtcaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcggtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125422 - DNA, 2003 bp, Homo sapiens; identical to SEQ ID NO: 125364
  Payload ID: 4591
  Gene Symbol: DDX39B
  Gene Name: DEAD (Asp-Glu-Ala-Asp) box polypeptide 39B
  Uniprot ID: Q13838
  ENST ID: ENST00000458640
  CDS Start-End: 502-1788

SEQ ID NO: 125423 - DNA, 932 bp, Homo sapiens; identical to SEQ ID NO: 125365
  Payload ID: 4591
  Gene Symbol: DDX39B
  Gene Name: DEAD (Asp-Glu-Ala-Asp) box polypeptide 39B
  ENST ID: ENST00000456662
  CDS Start-End: 238-932

SEQ ID NO: 125424 - DNA, 539 bp, Homo sapiens
  Payload ID: 4591
  Gene Symbol: DDX39B
  Gene Name: DEAD (Asp-Glu-Ala-Asp) box polypeptide 39B
  ENST ID: ENST00000432549
  CDS Start-End: 1-539
gttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccagga

SEQ ID NO: 125425 - DNA, 928 bp, Homo sapiens; identical to SEQ ID NO: 125326
  Payload ID: 4591
  Gene Symbol: DDX39B
  Gene Name: DEAD (Asp-Glu-Ala-Asp) box polypeptide 39B
  ENST ID: ENST00000446909
  CDS Start-End: 222-928

SEQ ID NO: 125426 - DNA, 583 bp, Homo sapiens; identical to SEQ ID NO: 125323
  Payload ID: 4591
  Gene Symbol: DDX39B
  Gene Name: DEAD (Asp-Glu-Ala-Asp) box polypeptide 39B
  ENST ID: ENST00000418760
  CDS Start-End: 175-583

SEQ ID NO: 125427 - DNA, 857 bp, Homo sapiens
  Payload ID: 4591
  Gene Symbol: DDX39B
  Gene Name: DEAD (Asp-Glu-Ala-Asp) box polypeptide 39B
  ENST ID: ENST00000493350
  CDS Start-End: 1-424
ggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtagaagactcgcccattttggaatgtgaccgtctgtccttcaggagaggacaccagggtgggggtgaaggagacactactgcccccacccctgacagcccccaccccatggcttccatcttttgcatcaccaccactcctgaacccccatttctgatttgtcagaatttttttttaacaaaactaaaaatgaaacacatgtgtctgtggtatctataa

SEQ ID NO: 125428 - DNA, 857 bp, Homo sapiens; identical to SEQ ID NO: 125427
  Payload ID: 4591
  Gene Symbol: DDX39B
  Gene Name: DEAD (Asp-Glu-Ala-Asp) box polypeptide 39B
  ENST ID: ENST00000464411
  CDS Start-End: 1-424

SEQ ID NO: 125429 - DNA, 857 bp, Homo sapiens; identical to SEQ ID NO: 125427
  Payload ID: 4591
  Gene Symbol: DDX39B
  Gene Name: DEAD (Asp-Glu-Ala-Asp) box polypeptide 39B
  ENST ID: ENST00000482080
  CDS Start-End: 1-424

SEQ ID NO: 125430 - DNA, 857 bp, Homo sapiens; identical to SEQ ID NO: 125427
  Payload ID: 4591
  Gene Symbol: DDX39B
  Gene Name: DEAD (Asp-Glu-Ala-Asp) box polypeptide 39B
  ENST ID: ENST00000484344
  CDS Start-End: 1-424

SEQ ID NO: 125431 - DNA, 857 bp, Homo sapiens; identical to SEQ ID NO: 125427
  Payload ID: 4591
  Gene Symbol: DDX39B
  Gene Name: DEAD (Asp-Glu-Ala-Asp) box polypeptide 39B
  ENST ID: ENST00000495997
  CDS Start-End: 1-424

SEQ ID NO: 125432 - DNA, 857 bp, Homo sapiens; identical to SEQ ID NO: 125427
  Payload ID: 4591
  Gene Symbol: DDX39B
  Gene Name: DEAD (Asp-Glu-Ala-Asp) box polypeptide 39B
  ENST ID: ENST00000497007
  CDS Start-End: 1-424

SEQ ID NO: 125433 - DNA, 857 bp, Homo sapiens; identical to SEQ ID NO: 125427
  Payload ID: 4591
  Gene Symbol: DDX39B
  Gene Name: DEAD (Asp-Glu-Ala-Asp) box polypeptide 39B
  ENST ID: ENST00000493860
  CDS Start-End: 1-424

SEQ ID NO: 125434 - DNA, 857 bp, Homo sapiens; identical to SEQ ID NO: 125427
  Payload ID: 4591
  Gene Symbol: DDX39B
  Gene Name: DEAD (Asp-Glu-Ala-Asp) box polypeptide 39B
  ENST ID: ENST00000484566
  CDS Start-End: 1-424

SEQ ID NO: 125435 - DNA, 1210 bp, Homo sapiens
  Payload ID: 4591
  Gene Symbol: DDX39B
  Gene Name: DEAD (Asp-Glu-Ala-Asp) box polypeptide 39B
  ENST ID: ENST00000467694
  CDS Start-End: 468-1210
gtcaccttcactaccgggccaaggaccccgtgggaactcgcagccttcgccacactcgttcctcgcgcatccacggaggggtgcctacagagaagacctgcgtggcaaaaacctaaacgaagagatgaggggcatggagaggagtaggataagagaataaagataacagtgggggggagacgttagtttcctttatatcttttgttactggcggtagcagtgaagttagaaacggttttaaaacaaatttcagacaggcattttccaaaggcaagcctggagcgcacggatctgtataaccgcggaaggccctgtttccggtcccttgcgcctgcgctcttgcagccaagaaggcgggaggctggagtagagggaagcctgcaaccggaagtgaaggcacatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagag

SEQ ID NO: 125436 - DNA, 2778 bp, Homo sapiens
  Payload ID: 4592
  Gene Symbol: DDX4
  Gene Name: DEAD (Asp-Glu-Ala-Asp) box polypeptide 4
  Uniprot ID: Q9NQI0
  ENST ID: ENST00000353507
  CDS Start-End: 100-2172
acctgacgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcgataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtctttcttatttctggtatattctttagggggcttagacatgtttaatgtttaaatgccaagtcttactatagtgtttattgatcttataaaacaagcaaataggatatgatacacttttggttaaaaattactgggtctcatttttacttgagtctttaaaacagtagtgtgtcactataatgtgataatctttaagagaaagtagaatacttaagcctttcaaagtgattttgatttttagatcatcagatgtatgatgaaaatggttaaatgtttgtgatgggagctctgtactcaatggcataacaatgtttatttttataatatacaatctttccttgaaataaaggatgaaacacttttccctta

SEQ ID NO: 125437 - DNA, 2324 bp, Homo sapiens
  Payload ID: 4592
  Gene Symbol: DDX4
  Gene Name: DEAD (Asp-Glu-Ala-Asp) box polypeptide 4
  Uniprot ID: Q9NQI0
  ENST ID: ENST00000354991
  CDS Start-End: 15-2087
aacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcgataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtc

SEQ ID NO: 125438 - DNA, 567 bp, Homo sapiens
  Payload ID: 4592
  Gene Symbol: DDX4
  Gene Name: DEAD (Asp-Glu-Ala-Asp) box polypeptide 4
  ENST ID: ENST00000506848
  CDS Start-End: 251-567
agtgggccgcttttctacgggaactggcctgaactcggccgtacgggctccccagtaaccgacctttggccaaagtgtggatggagtaggaggagttttgaagccgtccttcgaagcctttctgcctcggggtctcagagtcccacgggtgcccaaagtctgggcttgaggcctgcagaggaggcgaaggggccttattcctggcttcttcactgcgttttctctgaacagacatgaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatag

SEQ ID NO: 125439 - DNA, 1684 bp, Homo sapiens
  Payload ID: 4592
  Gene Symbol: DDX4
  Gene Name: DEAD (Asp-Glu-Ala-Asp) box polypeptide 4
  ENST ID: ENST00000503129
  CDS Start-End: 1-917
gtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttggattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaag

SEQ ID NO: 125440 - DNA, 1984 bp, Homo sapiens
  Payload ID: 4592
  Gene Symbol: DDX4
  Gene Name: DEAD (Asp-Glu-Ala-Asp) box polypeptide 4
  Uniprot ID: Q9NQI0
  ENST ID: ENST00000511853
  CDS Start-End: 20-1747
agaataaacatttctgggaatggggtctaggaatttatttttaaccaactctccagagtctagtaatgactgcgaagataatccaacacggaacagagggttttccaagagaggcgataatgacttagacccagacgaatgtatgcagcgcactggtggcctttttggttctagaagaccagtattaagtggcacaggtaatggtgatacttctcaaagcagaagtggcagtggaagtgaacgagattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtc

SEQ ID NO: 125441 - DNA, 566 bp, Homo sapiens
  Payload ID: 4592
  Gene Symbol: DDX4
  Gene Name: DEAD (Asp-Glu-Ala-Asp) box polypeptide 4
  ENST ID: ENST00000514679
  CDS Start-End: 90-566
ttttctacgggaactggcctgaactcggccgtacgggctccccagtaaccgacctttggccaaagtgtggatggaaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggagga

SEQ ID NO: 125442 - DNA, 470 bp, Homo sapiens
  Payload ID: 4592
  Gene Symbol: DDX4
  Gene Name: DEAD (Asp-Glu-Ala-Asp) box polypeptide 4
  ENST ID: ENST00000515709
  CDS Start-End: 44-470
gagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgact

SEQ ID NO: 125443 - DNA, 2884 bp, Homo sapiens
  Payload ID: 4592
  Gene Symbol: DDX4
  Gene Name: DEAD (Asp-Glu-Ala-Asp) box polypeptide 4
  Uniprot ID: Q9NQI0
  ENST ID: ENST00000505374
  CDS Start-End: 93-2267
gcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtctttcttatttctggtatattctttagggggcttagacatgtttaatgtttaaatgccaagtcttactatagtgtttattgatcttataaaacaagcaaataggatatgatacacttttggttaaaaattactgggtctcatttttacttgagtctttaaaacagtagtgtgtcactataatgtgataatctttaagagaaagtagaatacttaagcctttcaaagtgattttgatttttagatcatcagatgtatgatgaaaatggttaaatgtttgtgatgggagctctgtactcaatggcataacaatgtttatttttataatatacaatctttccttgaaataaaggatgaaacacttttcccttaagttttccatc

SEQ ID NO: 125444 - DNA, 2451 bp, Homo sapiens
  Payload ID: 4592
  Gene Symbol: DDX4
  Gene Name: DEAD (Asp-Glu-Ala-Asp) box polypeptide 4
  Uniprot ID: Q9NQI0
  ENST ID: ENST00000514278
  CDS Start-End: 100-2214
acctgacgcagtgggcgtcttgcacgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagaggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacataggggatgaaagaactatggtctttgttgaaactaagaaaaaagcagattttattgcaacttttctttgtcaagaaaaaatatcaactacaagtattcatggtgatcgggaacagagagagcgggagcaagctcttggagattttcgctttggaaagtgcccagttcttgttgctacttcagtagctgccagagggctggatattgaaaatgtgcaacatgttatcaattttgatcttccttctaccattgatgaatatgttcatcgaattgggcgtactggtcgttgtgggaatactggcagagcaatttccttttttgatcttgaatcggataaccatttagcacagcctctagtaaaagtattgacagatgctcaacaggatgttcctgcatggttggaagaaattgcctttagtacatacattcctggcttcagtggtagtacaagaggaaacgtgtttgcatcagttgataccagaaagggcaagagcactttgaacacagctgggttttcttcttcacaagctcccaatccagtagatgatgagtcatgggattaaagccaaaacatccttcaagtctgtggttttgatgcagagaagaaaatagttttgatttttgagtttttaacagaagtataaaacttaacattctcatagctcctgtccttgtattctcactcctacacttaaaaaaaaaatccttactgactagttatgtgagatgctaaaacttacaacattgcagttactgatacaaatggtgttaactgggaatattaaagcattctaaatgtc

SEQ ID NO: 125445 - DNA, 1631 bp, Homo sapiens
  Payload ID: 4592
  Gene Symbol: DDX4
  Gene Name: DEAD (Asp-Glu-Ala-Asp) box polypeptide 4
  ENST ID: ENST00000506511
  CDS Start-End: 77-1631
acgtgcagccgtttaagtcgcgtgggcgcctgcgagggcttgggagagcaagccgcggagagaacttgaagccaccatgggagatgaagattgggaagcagaaatcaaccctcatatgtcttcctatgttcccatatttgagaaggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagaggctatcgagatggaaataattcagaagcttcagggccatacagaagaggtggaagaggtagtttccgaggttgccgtggaggatttggtctaggaagtccaaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcgacaaatacgacactattcttgtggaagtgtctggacatgatgcaccaccagcaattctgacttttgaagaagctaatctctgtcagacactgaataacaacattgctaaagctggttatactaagcttactcctgtgcaaaaatacagtattcctatcatacttgcaggacgagatttgatggcttgcgctcaaacagggtctgggaagactgcggcttttctcctaccaattttggctcatatgatgcatgatggaataactgccagtcgttttaaagagttgcaggaaccagagtgtattattgtagcaccaactcgagaattggtcaaccagatttatttggaagccagaaaattttcttttgggacttgtgtaagagctgttgttatatatgggggaacccagctgggacattcaattcgacaaatagtacaaggctgtaatatattatgtgctactcctggaagactgatggatatcataggcaaagaaaagattggtctcaaacagatcaaatacttagttttggatgaagctgatcgcatgttggatatgggttttggtccagaaatgaagaagttaatttcttgcccaggaatgccatcaaaggaacagcgccaaacccttatgttcagtgcaacttttccagaggaaattcaaaggttggctgcagagtttttaaagtcaaattatctgtttgttgctgttggacaagtgggtggagcatgtagagatgttcagcagaccgttctccaagttggccagttctcaaaaagagaaaagctcgttgaaattctgcgaaacatag

SEQ ID NO: 125446 - DNA, 549 bp, Homo sapiens
  Payload ID: 4592
  Gene Symbol: DDX4
  Gene Name: DEAD (Asp-Glu-Ala-Asp) box polypeptide 4
  ENST ID: ENST00000511491
  CDS Start-End: 81-549
ttctcaattctaaattttaaagtgagtgtaccacctgggaatagaacagcgaaagatgtgaagttaagaaagattttataatgtggcaattatatagtccagaaatctcaaccattaggcatttgcacgttgcctgcaggcttattggggataggtattctggagaaaatggagacaattttaacaggactccagcttcatcatcagaaatggatgatggaccttctcgaagagatcatttcatgaaaagtggatttgcctctgggcggaattttggaaacagagatgctggtgagtgtaataagcgagataatacatccacaatgggtggttttggagttggaaagagttttggaaacagaggtttttcaaacagcaggtttgaagatggtgatagctctggtttctggagagagtctagtaatgactgcgaagataatccaacacggaacagagggttttccaagagaggcggctatcgagatggaaataattcagaagcttcagggccatacagaagaggtggaagaggtagtttccgaggttgcc

SEQ ID NO: 125447 - DNA, 554 bp, Homo sapiens
  Payload ID: 4592
  Gene Symbol: DDX4
  Gene Name: DEAD (Asp-Glu-Ala-Asp) box polypeptide 4
  ENST ID: ENST00000507645
  CDS Start-End: 1-152
tggggtctaggaatttatttttaaccaactctccagagtctagtaatgactgcgaagataatccaacacggaacagagggttttccaagagaggcggtaaggaccacattttggaacaatttgtacttaacacagagacactaaactggtaaaactgattttgaaggagctggatgaaaaacactgatcgtgaaaacctttgaagaaaaatactttggtatatgttttctgcttttaatatttgaataatgacttagacccagacgaatgtatgcagcgcactggtggcctttttggttctagaagaccagtattaagtggcacaggtaatggtgatacttctcaaagcagaagtggcagtggaagtgaacgaggtggttacaaaggtttaaatgaagaagtaataacaggctctggaaagaattcttggaagtcagaagcagaaggaggagaaagtagtgatactcaaggaccaaaagtgacctacataccccctcctccacctgaggatgaggactccatctttgcacattatcagacaggcataaacttcg

SEQ ID NO: 125448 - DNA, 2137 bp, Homo sapiens
  Payload ID: 4593
  Gene Symbol: DDX41
  Gene Name: DEAD (Asp-Glu-Ala-Asp) box polypeptide 41
  ENST ID: ENST00000330503
  CDS Start-End: 1-1923
aggagagaggcgagaccccgcgcgtgtgggagcgggcgtgaagaggggagcaggccgtgcctgactggcgtgtgcttgcagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctgggatgggccaggctggtcctggctgcctgttccctgtgctcttcagaattactgtttttgtttccttttaccccagctgccattaaagcccaaacctctagccca

SEQ ID NO: 125449 - DNA, 776 bp, Homo sapiens
  Payload ID: 4593
  Gene Symbol: DDX41
  Gene Name: DEAD (Asp-Glu-Ala-Asp) box polypeptide 41
  ENST ID: ENST00000508279
  CDS Start-End: 1-520
tatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacatgctgtgcagtcctctgcagaccaccagaggccctggaccaggccctctgttcacagatgggccagaccccatcccggaggccttcctccacggacttctgagtattagggagatgcggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgac

SEQ ID NO: 125450 - DNA, 2607 bp, Homo sapiens
  Payload ID: 4593
  Gene Symbol: DDX41
  Gene Name: DEAD (Asp-Glu-Ala-Asp) box polypeptide 41
  Uniprot ID: Q9UJV9
  ENST ID: ENST00000507955
  CDS Start-End: 525-2393
acacaggcgcagtcagggaggcagggtgtgtcgagcggtttatcccgcaaccccggcgtccccggcagggatgaaagcgcagggcccacgcgaactcggcccgcagctcccggccctagaggacgcactgtccgccggcaggggcgtgcccaagacgccatgctctgggagaggttgggcacctggcaggccgccccgactccggatcagctgtctccgctgcgtacgtcttcctcttccaatgggcttggattgagccttctagcgcatattccaagtcctccaatgtcccacaatgccttgcagccggtttcgccctcggtcctggcaactgtcgcgtaaccacccatgaaagcgtccatgcctcgccgtgcgatagtatctccggaacaaatttgtccctctgcgcgatccggaactccgaggtcgttcctacgcgccgtcgttcgcctcttcacatcggattgggtctcacgcaaggatgaggcggggtttcgccgtggcgcgcatgcgtgcagcaaagaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggccctatggactcatcatctgcccctcgcgggagctggcccggcagacccatggcatcctggagtactactgccgcctgctgcaggaggacagctcaccactcctgcgctgcgccctctgcattgggggcatgtccgtgaaagagcagatggagaccatccgacacggtgtacacatgatggtggccaccccggggcgcctcatggatttgctgcagaagaagatggtcagcctagacatctgtcgctacctggccctggacgaggctgaccgcatgatcgacatgggcttcgagggtgacatccgtaccatcttctcctacttcaagggccagcgacagaccctgctcttcagtgccaccatgccgaagaagattcagaactttgctaagagtgcccttgtaaagcctgtgaccatcaatgtggggcgcgctggggctgccagcctggatgtcatccaggaggtagaatatgtgaaggaggaggccaagatggtgtacctgctcgagtgcctgcagaagacacccccgcctgtactcatctttgcagagaagaaggcagacgtggacgccatccacgagtacctgctgctcaagggggttgaggccgtagccatccatgggggcaaagaccaggaggaacggactaaggccatcgaggcattccgggagggcaagaaggatgtcctagtagccacagacgttgcctccaagggcctggacttccctgccatccagcacgtcatcaattatgacatgccagaggagattgagaactatgtacaccggattggccgcaccgggcgctcgggaaacacaggcatcgccactaccttcatcaacaaagcgtgtgatgagtcagtgctgatggacctcaaagcgctgctgctagaagccaagcagaaggtgccgcccgtgctgcaggtgctgcattgcggggatgagtccatgctggacattggaggagagcgcggctgtgccttctgcgggggcctgggtcatcggatcactgactgccccaaactcgaggctatgcagaccaagcaggtcagcaacatcggtcgcaaggactacctggcccacagctccatggacttctgagccgacagtcttcccttctctccaagaggcctcagtccccaagactgccaccagtctacacatacagcagccccctggacagaatcagcatttcagctcagctggcctgggatgggccaggctggtcctggctgcctgttccctgtgctcttcagaattactgtttttgtttccttttaccccagctgccattaaagcccaaacctctagccca

SEQ ID NO: 125451 - DNA, 618 bp, Homo sapiens
  Payload ID: 4593
  Gene Symbol: DDX41
  Gene Name: DEAD (Asp-Glu-Ala-Asp) box polypeptide 41
  ENST ID: ENST00000504781
  CDS Start-End: 1-381
ctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcagtttcatcatctgcaacttgtaggggtagtgccagttttacaggctttggggctctgagaaagtacctgtgagtcatgaagacgatgtcggttggttttcatagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctggaacaagagaagaggttacccttctcaaagcgcgaggggcccta

SEQ ID NO: 125452 - DNA, 819 bp, Homo sapiens
  Payload ID: 4593
  Gene Symbol: DDX41
  Gene Name: DEAD (Asp-Glu-Ala-Asp) box polypeptide 41
  ENST ID: ENST00000509576
  CDS Start-End: 6-611
aaagaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcaggggtagtgccagttttacaggctttggggctctgagaaagtacctgtgagtcatgaagacgatgtcggttggttttcatagccatcctgagaggcctgaagaagaaaggcattcaccacccaacacccattcagatccagggcatccccaccattctatctggccgtgacatgataggcatcgctttcacgggttcaggcaagacactggtgttcacgttgcccgtcatcatgttctgcctgg

SEQ ID NO: 125453 - DNA, 569 bp, Homo sapiens
  Payload ID: 4593
  Gene Symbol: DDX41
  Gene Name: DEAD (Asp-Glu-Ala-Asp) box polypeptide 41
  ENST ID: ENST00000510171
  CDS Start-End: 17-166
atgcgtgcagcaaagaatggaggagtcggaacccgaacggaagcgggctcgcaccgacgaggtgcctgccggaggaagccgctccgaggcggaagatgaggacgacgaggactacgtgccctatgtgccgttacggcagcgccggcagctactgccaggatcctgacgctgaccttgtggactccatgcccatcctatctgtggatcccgggtggaacctcagctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagc

SEQ ID NO: 125454 - DNA, 606 bp, Homo sapiens
  Payload ID: 4593
  Gene Symbol: DDX41
  Gene Name: DEAD (Asp-Glu-Ala-Asp) box polypeptide 41
  ENST ID: ENST00000629036
  CDS Start-End: 1-606
atggaggagtcggaacccgaacggaagcgggctcgcaccgacgaggtgcctgccggaggaagccgctccgaggcggaagatgaggacgacgaggactacgtgccctatgtgccgttacggcagcgccggcagctactgctccagaagctgctgcagcgaagacgcaagggagctgcggaggaagagcagcaggacagcggtagtgaaccccggggagatgaggacgacatcccgctaggccctcagtccaacgtcagcctcctggatcagcaccagcaccttaaagagaaggctgaagcgcgcaaagagtctgccaaggagaagcagctgaaggaagaagagaagatcctggagagtgttgccgagggccgagcattgatgtcagtgaaggagatggctaagggcattacgtatgatgaccccatcaaaaccagctggactccaccccgttatgttctgagcatgtctgaagagcgacatgagcgcgtgcggaagaaataccacatcctggtggagggagacggtatcccaccacccatcaagagcttcaaggaaatgaagtttcctgcaggggtagtgccagttttacaggctttggggctctga

SEQ ID NO: 125455 - DNA, 150 bp, Homo sapiens
  Payload ID: 4593
  Gene Symbol: DDX41
  Gene Name: DEAD (Asp-Glu-Ala-Asp) box polypeptide 41
  ENST ID: ENST00000625286
  CDS Start-End: 1-150
atggaggagtcggaacccgaacggaagcgggctcgcaccgacgaggtgcctgccggaggaagccgctccgaggcggaagatgaggacgacgaggactacgtgccctatgtgccgttacggcagcgccggcagctactgccaggatcctga

SEQ ID NO: 125456 - DNA, 2513 bp, Homo sapiens
  Payload ID: 4594
  Gene Symbol: DDX43
  Gene Name: DEAD (Asp-Glu-Ala-Asp) box polypeptide 43
  Uniprot ID: Q9NXZ2
  ENST ID: ENST00000370336
  CDS Start-End: 159-2105
agtgggcgggatagagagcgtgggcgggggggctagcctcgtgcgggctccttaagtagcggctgcgtggcttccctggcacgctactcttacgacgtcacggtcaggtggtgcagagctggacggcaacgacgtcggacgcgccccttcttggaacaatgtcccaccacggaggagctcccaaggcctctacgtgggtcgttgctagtcggcgaagctcgacagtgtcccgagcgccagagaggaggccggcggaggagttgaatcgaacaggtcctgagggatatagtgtcggcagaggtggtcgctggagaggcacctctaggcccccggaggccgtggccgctggtcacgaggaactgccgctgtgttttgctttgaagagccactttgttggcgcggtaatcggtcgtggtgggtcaaaaataaagaatatacaaagtacaacaaacaccacaatccaaataatacaagaacaaccagaatcattagtcaaaatttttggcagcaaggcaatgcaaacgaaagcaaaagcagtgatagacaattttgttaaaaagctagaagaaaattacaattcagaatgcggaattgatactgcattccaaccttctgttggaaaagatggaagcacagataacaatgttgttgcaggagatcggccattgatagattgggatcaaattagagaggaaggtttgaaatggcaaaaaacaaagtgggcagatttaccaccaattaagaaaaacttttataaagagtccactgccacaagtgccatgtcaaaagtagaagcagatagttggaggaaagaaaattttaatataacgtgggatgacttgaaggatggggagaaacgacctatccccaatcctacctgcacatttgatgacgcctttcaatgttatcctgaggttatggaaaacattaaaaaggcaggttttcaaaagccaacacctattcagtcacaggcatggcccattgtgttgcaaggaatagatcttataggagtagcccagactggaacaggaaagacattgtgttatttaatgcctggatttattcatctggtccttcaacccagccttaaaggtcaaaggaatagacccggcatgttagttctaactcccactcgggaattagcacttcaagtagaaggagaatgttgcaaatattcatataaagggcttcggagtgtttgtgtatatggtggtggaaatagagatgaacaaatagaagagcttaaaaaaggtgtagatatcataattgcaactcccggaagattgaatgatctgcaaatgagtaacttcgtcaatctgaagaatataacctacttggttttagatgaagcagacaagatgttggacatgggatttgaaccccagataatgaagattttgttagatgtgcgcccagataggcagacagttatgaccagtgctacatggcctcattcagttcatcgcctcgcacaatcttatttgaaagaaccaatgattgtctatgttggtacattggatctagttgctgtaagttcagtgaagcaaaatataattgtaaccaccgaggaagagaaatggagtcacatgcaaacttttctacagagtatgtcatccacagacaaagtcattgtcttcgtttctcgaaaagctgttgcggatcacttatcaagtgacctaatacttggaaatatatcagtagagtctctgcatggagatagagaacagagagatcgggagaaagcattagagaactttaaaacaggcaaagtgagaatactaattgcaactgatctagcctctagaggacttgatgtccatgacgttacacatgtctataattttgactttccacggaatattgaagaatacgtacaccgaatagggcgcacgggaagagcagggaggactggtgtttccattacaactttgactagaaatgattggagggttgcctctgaattgattaatattctggaaagagcaaatcagagtattccagaggagcttgtatcaatggctgagaggtttaaggcacatcaacagaaaagggaaatggaaagaaaaatggaaagacctcaaggaaggcccaagaagtttcattaatgtcttctgtactagtggggtagagaattcaagattttttagaaatatagtaagacggaagtattggacatgttggcagtatgaagagaccggactgatttgactgattcttaaaataatagtgtttgaaaatatagaatccagtgttttatactttctttaataaaaatagaagtatttaaacttggaagttgtttcctggatttttattaaggagtgtagcattagaatgtttttcttttaatcttttaaactgtctcctgtaattttgctgtatgtcataaggccagtctttcagaatttaatgttcagattttgtcatggcagtgaaaaagatgttttcaaacaaagaatcagcacctgaaaaaatactgttaataaatgttcgtttctgtgataaaaagacaa

SEQ ID NO: 125457 - DNA, 3821 bp, Homo sapiens
  Payload ID: 4595
  Gene Symbol: DDX46
  Gene Name: DEAD (Asp-Glu-Ala-Asp) box polypeptide 46
  Uniprot ID: Q7L014
  ENST ID: ENST00000354283
  CDS Start-End: 136-3231
ggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagta

SEQ ID NO: 125458 - DNA, 5689 bp, Homo sapiens
  Payload ID: 4595
  Gene Symbol: DDX46
  Gene Name: DEAD (Asp-Glu-Ala-Asp) box polypeptide 46
  ENST ID: ENST00000452510
  CDS Start-End: 159-3257
gttttcgttggccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagacgttccagaagtagagagagagacagaagccgagagcgaagaagatctcgaagtagagacaggagacgctcaaggagtagaagccggggccggcgatcccgatcctccagtcctggaaataaaagcaagaaaactgagaatagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgttaaggggctattcactttatcctgtactttcaatgaaattgtgatcatttcctaagaaaaggtaaaattcactatcatattttgtgtccccaccttgatgttacatgactctggaacaatatgaactggatttaagaatgttataatagaagtcttacaaaatgggttgagagtttttgtttcaatttttatcatcataaatgggcaaaaagtagttggactaatttcggtttttatacaagtaaagatttaatagtataaggatttttttgcatttctttacactgagtgtaaaactctacaaagagttatagtatttactactttgaggtttccctcacaacttctggctccatacctagcccctcttttataatcttccttaaaagaaagagtgtagcctataaatactaaatatgataccttttccttctagaaagtgtttatttatatatctatacatgttgtatgtacaaatatcctactacttttaatctgatttttcttcaggattattgagtaggttgtgaattttctttcttaaaaattgtaaaacataatggtacccaagttttaaacttagatgtgcttcatcttagtgaaatttaattcacaaggaatcataaattgtgtttttgaggctgggcgcagtgactcacacctgtatcccagcaatttgggaggccgaggtgggcagatcacttgaggtcaggagttcaagactagcctggtcaacatggtgaaaccctgtctctactaaaaatacaaaaattagtcggcatggtggtgggtggctgtaatcccagctactcaggaggctgaggcagaagaatctgagccaagataacaccattgcactccagcctgggcgacagagtgagactatctcaaaaataaataaataaataaataaatagtatttttgagccttcaagatacagttcctgaatattctaatttaaattgttataattggattacctaatattcttttcaagactcctgatgtattaacttcatgttattgtcacttttcaaaaaaggaatttttttcaggagttaaataaagtcagtcttttatatccaagggtttcaaacccacagattaaaccaaccacagatcaaaaatagaaaaaaaaaaaaaaagaaaaaaagaatgtaaaattttaaaaatacagtttaacagctgtaaaagttttactataacatttacattgtgttaggtattttaagtaatttaaaggttacagtatacaggcggttaaagtatacaggaggatgtgcatcggttatatgcatatagcaagccatttcatataagaggcttgaacatccatggattttggtatagaggaggggtttaaggggtgtcctgcaatcagtccccctctcataccaaaggatgactgtatatttcttaaatgaagagactttcattctttaaatattattgacttacagtttaaaaataaataaataaaagcatactatagttgtaaaaacaaataattttaatagtatattcagtggctgaagtgatagggagtattaatcattatttcttcagtataaagttattcttcctgaaaaagtaagatatacctgggaaatattcttggatccttcacacatccacttaatttcttgaaggaagaaaacagacaaaagacatgtaacaacagaaacaaataaaccacttactgtaaaatttcagaaattgtgggctcattccctccctctagtttatttatttgctcatctttatcacctaatggtagtttgttttctttggtagagtatatggcagtcccacatcgatgataattggtgctcccttcatccaactggatcactttgagattcagttttacatcattttagcattttgtttgtatatcagttgtgatgagccactgataaaattttgttctaaaatgaaacatattactttgttagtacattttttagtgtcacactgacttttaaaatttgaatgatatatagactttgtttttttaatgcaatatgaatatttgctcatgttttctaaattccttataaaataaaattaattcgaattcaatctgcactttcttaaaa

SEQ ID NO: 125459 - DNA, 530 bp, Homo sapiens
  Payload ID: 4595
  Gene Symbol: DDX46
  Gene Name: DEAD (Asp-Glu-Ala-Asp) box polypeptide 46
  ENST ID: ENST00000507053
  CDS Start-End: 1-211
tgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtcagctctctggagctaaagacagctacgtttcccttaccagaaaatgatgcatcctgttgccagcagtaatccagctttctgtgggcctggcaagccttcctgcctcaatgaagatgccatgagagctgctgatcagtttgacatatattcctcccagcaaagcaaatacagccacacagtcaaccacaaaccaatggtttgtcagaggcaagacccattaaatgaaacacacttgcagactacaagtggcagaagcatagaaataaaagatgaact

SEQ ID NO: 125460 - DNA, 571 bp, Homo sapiens
  Payload ID: 4595
  Gene Symbol: DDX46
  Gene Name: DEAD (Asp-Glu-Ala-Asp) box polypeptide 46
  ENST ID: ENST00000513592
  CDS Start-End: 1-89
ttgaagttccagaactagcaaaaatgtctcaagaaggcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatg

SEQ ID NO: 125461 - DNA, 3565 bp, Homo sapiens
  Payload ID: 4595
  Gene Symbol: DDX46
  Gene Name: DEAD (Asp-Glu-Ala-Asp) box polypeptide 46
  ENST ID: ENST00000507392
  CDS Start-End: 161-1576
ctgttttcgttggccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtgatgctgtcagataatggctgatgtggctcgatgcttcatctcagtcttagttttatgatgtgttttggagagggctgttttctgaattttacaggttcttcaggccctatgatggtcgggtcacaaatcttcgaagagtgacatatgttgttttagatgaagcagacagaatgtttgacatgggttttgaaccccaggtcatgcgcatcgtggataatgttcgtcctgatcgacagacggttatgttttcagctactttccccagagctatggaggctttggctcgcaggatcctcagtaaacctattgaagtacaagttggaggcaggagtgtggtttgctcagatgtggagcaacaagtgattgtgattgaagaagaaaagaaattcttgaagttacttgagcttctaggccattatcaagagtcaggatctgtcattatatttgtggataagcaggaacatgctgatggtcttcttaaggatttaatgagagcatcttatccttgcatgtctcttcatggaggcattgatcaatatgacagagatagcatcataaatgactttaagaatgggacctgcaaacttcttgtggctacctctgttgctgcccgaggtctagatgtgaaacatctgattcttgtagtaaattatagctgccccaaccattatgaggattatgtacacagagcagggcggactggaagagcaggaaacaagggttatgcttatacttttatcacagaggatcaagctcgctatgctggtgacataattaaagctcttgaattgtcagggactgcagtacctcctgatttagagaaactgtggagtgatttcaaagatcagcagaaagctgaggggaaaataattaaaaagagtagtgggttctctggtaagggattcaagtttgatgaaacagaacaagctttggctaatgagaggaagaagttacaaaaagcagctcttggtctacaagattcagatgatgaggatgctgcagttgatattgatgagcaaattgaaagcatgtttaattcaaagaagagagtaaaggatatggctgctcctggaacatcaagtgttcctgctccaactgcaggaaatgctgagaaattagaaattgctaagagattggctcttagaatcaatgcccagaagaatttgggcatcgagtctcaggtagatgtgatgcagcaggccaccaatgcaattcttaggggtggcaccattctggctcccactgtttctgcaaaaaccattgcagaacaacttgctgaaaagatcaatgccaagctcaattatgtgccgttagagaaacaagaagaagagagacaggatggtggacagaatgaatcttttaagagatatgaagaagaattagagatcaatgacttcccacagactgctaggtggaaagttacctctaaggaagctctgcagagaatcagtgaatactctgaagccgcaattacaatcagaggaacctacttccctcctggcaaagaacccaaggaaggcgagcggaagatttacttggcaattgaaagtgccaatgaactggctgtgcagaaagcaaaggcagaaatcaccaggctcataaaagaagagctgatccggctgcaaaattcataccaaccaacaaataaaggaagatacaaagtcttatagacatccggaaaaaagatttttacctgtgctggtctatgatgtatgtggcagttgctgtctgcagtttacaatgtattgtaaatgaagattttttaaattctatcttgctgattttttttaaatataagaaactggtacttggtaaagaaatctgtccgtaagtacccccacaatcagtcaaactatatttaaagccagcctgttttcagagtatgatgtcctttaatgtaaactcaaatatcaatattttaaatgtccggataatattctagaggtttaaaaaatggaaatatttgaactttctattgaagacaataaagtacacaagtcgtt

SEQ ID NO: 125462 - DNA, 1584 bp, Homo sapiens
  Payload ID: 4595
  Gene Symbol: DDX46
  Gene Name: DEAD (Asp-Glu-Ala-Asp) box polypeptide 46
  ENST ID: ENST00000628477
  CDS Start-End: 169-1584
agcacgtcctgttttcgttggccgcgctgggatggccgccacagctgtaggtgctgctagtgtttagcgctggtctttgccgggcgttgagggcagctcagcctccttgtttgtccggttcgcctgtgcgtggtactcaagggcaccagtattcccgcggtcggcagcatgggtcgggagtcacgccactatcgaaaacgatcggcatcccggggtcgctctggaagtcggtctagaagtcgctcaccctcagacaaaagaagtaaacgtggagatgacagacggtctagaagtagagatagagataggaggagagagaggtctcgtagcagggataaaagaagatctcggtcaagggacaggaagcgtctgagatctaggtccaaagagaaaactgatggtggggaaagttctaaagagaagaaaaaagacaaagatgacaaggaggatgaaaaagaaaaagatgctggcaactttgaccagaataagctggaagaagaaatgagaaagcgaaaagaaagagtagaaaaatggcgagaagagcaacgtaaaaaggctatggaaaacataggagaactgaaaaaggaaatcgaagagatgaaacaagggaaaaagtggagtttagaggacgatgatgatgacgaagatgatcctgcagaagctgaaaaggagggaaatgaaatggagggtgaggagttagatccattagatgcttacatggaagaagtgaaagaggaagtaaaaaaatttaacatgagaagtgtaaaaggtggtgggggaaatgaaaagaagtctgggccaacggtcacaaaagttgtcactgttgtgacaaccaaaaaagcagttgtggattctgataagaagaaaggtgagctgatggagaatgaccaggatgccatggagtattcttcagaggaggaagaagttgatcttcagacagcccttacagggtatcaaacaaaacagcgaaagcttctagaaccagttgatcatggaaaaattgagtatgagccatttaggaaaaacttctatgttgaagttccagaactagcaaaaatgtctcaagaagaggtaaatgtgtttcgattggaaatggagggcattacagttaaaggaaaaggttgccccaaaccaattaaatcctgggtccagtgtggaatttccatgaagatcttaaattccctcaagaagcatggctatgaaaagcccacgcccatccaaacccaagctattcctgctataatgtctggacgagatttgattggcattgccaaaacaggaagtggaaagaccattgcttttctgttgcccatgtttagacacatcatggatcagaggtcattagaggaaggagaggggccaatagctgtcatcatgactccaactcgagaactggctttacagattactaaagagtgtaagaagttttccaagactttgggacttagagtggtctgtgtttacggaggaacaggaatcagtgagcagattgctgagctgaaaagaggtgctgaaattattgtttgcacacctggtcgaatgattgacatgttagccgctaacagtggtgatgctgtcagataa

SEQ ID NO: 125463 - DNA, 1698 bp, Homo sapiens
  Payload ID: 4596
  Gene Symbol: DDX47
  Gene Name: DEAD (Asp-Glu-Ala-Asp) box polypeptide 47
  Uniprot ID: Q9H0S4
  ENST ID: ENST00000352940
  CDS Start-End: 53-1273
atttcccagcatcccgcgcgccgcagacccacttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaa

SEQ ID NO: 125464 - DNA, 1817 bp, Homo sapiens
  Payload ID: 4596
  Gene Symbol: DDX47
  Gene Name: DEAD (Asp-Glu-Ala-Asp) box polypeptide 47
  Uniprot ID: Q9H0S4
  ENST ID: ENST00000358007
  CDS Start-End: 23-1390
acttccggagacctcacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaatcacttttatgaaggctcgagttctgctgttctgtaaaagagaattggagaatgaaacctgctccaacagagatcatgagactgaaattggtcagaattgtgtccagaatgtgctcagctaattcagtattcttccccattctgggttggagtttactgcagagtaattcttacagtgctgatgtcaagactgttactgttcttcgactttgattccttgctcatgacatgagtagggtgtgctcttctgtcacttcacacagaccttttgccttttttagctgcaagtcaaggactaggttgatgatgcccatgacctgtaattgtaaagaagcttggacatctgcaaatgatatttaaaccatcttggcttgtgctttattcaaactaatgtgaaacaataaatttaaatattatttttaaaaga

SEQ ID NO: 125465 - DNA, 597 bp, Homo sapiens
  Payload ID: 4596
  Gene Symbol: DDX47
  Gene Name: DEAD (Asp-Glu-Ala-Asp) box polypeptide 47
  ENST ID: ENST00000544400
  CDS Start-End: 9-597
cacacaagatggcggcacccgaggaacacgattctccgaccgaagcgtcccagccgattgtggaagaggaggaaactaaaacatttaaagacctgggtgtgacagatgtgttgtgtgaagcttgtgaccagttgggatggacaaaacccaccaagatccagattgaagctattcctttggccttacaagctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaagagtaagcgcctaggatcccttaataagt

SEQ ID NO: 125466 - DNA, 1830 bp, Homo sapiens
  Payload ID: 4597
  Gene Symbol: DDX49
  Gene Name: DEAD (Asp-Glu-Ala-Asp) box polypeptide 49
  Uniprot ID: Q9Y6V7
  ENST ID: ENST00000247003
  CDS Start-End: 68-1519
gtcggcgcgcgccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcc

SEQ ID NO: 125467 - DNA, 1691 bp, Homo sapiens
  Payload ID: 4597
  Gene Symbol: DDX49
  Gene Name: DEAD (Asp-Glu-Ala-Asp) box polypeptide 49
  ENST ID: ENST00000602113
  CDS Start-End: 5-130
aaggatggcaggcttcgcggagctcgggctgtcatcgtggctcgtggaacaatgtcggcagctgggtttgaagcagcccacgcccgtgcagctcggctgcatccccgccatcctggaggaagctgtctgaggatccctatggcatcttctgcctcgtcctgacacccaccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttga

SEQ ID NO: 125468 - DNA, 721 bp, Homo sapiens
  Payload ID: 4597
  Gene Symbol: DDX49
  Gene Name: DEAD (Asp-Glu-Ala-Asp) box polypeptide 49
  ENST ID: ENST00000594021
  CDS Start-End: 28-384
aaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcaca

SEQ ID NO: 125469 - DNA, 1882 bp, Homo sapiens
  Payload ID: 4597
  Gene Symbol: DDX49
  Gene Name: DEAD (Asp-Glu-Ala-Asp) box polypeptide 49
  ENST ID: ENST00000595858
  CDS Start-End: 16-516
caagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccgtggagctgaccagccacctctgcctccaggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttc

SEQ ID NO: 125470 - DNA, 753 bp, Homo sapiens
  Payload ID: 4597
  Gene Symbol: DDX49
  Gene Name: DEAD (Asp-Glu-Ala-Asp) box polypeptide 49
  ENST ID: ENST00000598972
  CDS Start-End: 14-352
agcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccagacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccg

SEQ ID NO: 125471 - DNA, 557 bp, Homo sapiens
  Payload ID: 4597
  Gene Symbol: DDX49
  Gene Name: DEAD (Asp-Glu-Ala-Asp) box polypeptide 49
  ENST ID: ENST00000593361
  CDS Start-End: 15-140
aagcggccacaaggatggcaggcttcgcggagctcgggctgtcatcgtggctcgtggaacaatgtcggcagctgggtttgaagcagcccacgcccgtgcagctcggctgcatccccgccatcctggaggaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgca

SEQ ID NO: 125472 - DNA, 1912 bp, Homo sapiens
  Payload ID: 4597
  Gene Symbol: DDX49
  Gene Name: DEAD (Asp-Glu-Ala-Asp) box polypeptide 49
  ENST ID: ENST00000629999
  CDS Start-End: 68-568
gtcggcgcgcgccggaagcgcggatcacacgggcccctacaaggggcccctacaagcggccacaaggatggcaggcttcgcggagctcgggctgtcatcgtggctcgtggaacaatgtcggcagctgggtttgaagcagcccacgcccgtgcagctcggctgcatccccgccatcctggagggtcgagactgcttgggctgtgctaagacaggcagtgggaagacagcagcgtttgtccttcccatcttgcagaagctgtctgaggatccctatggcatcttctgcctcgtcctgacacccaccaggggtcctgcagaattaaacaagatggccccggtgcagtggctcacacctgtaatcccagcactttgggagctccagggagctggcctaccagatcgcagagcagttccgggtcctggggaagcctctagggctgaaagactgcatcatcgtcggtggcatggacatggtggcccaggcgctggagctctctcggaaaccacacgtggtcatcgccacgccggggcgcctggcagatcacctgcgcagctccaacacttttagtataaagaagatccgcttcctggtgatggatgaggcagaccggctgctggaacagggctgcactgacttcaccgtggacctggaggccatcctggcggctgtgccggcccgcaggcagacactgctgttcagcgccacgctgaccgacacactccgggagctgcagggtctggccaccaaccagcccttcttctgggaagcacaggccccggtgagcaccgtggagcagctggaccagcgctacctgctggtgcctgagaaggtcaaggacgcctacctggtccacctgatccagcgcttccaggatgagcacgaggactggtccattatcatcttcaccaacacgtgcaagacctgccagattctgtgcatgatgctgcgcaaattcagcttccccaccgtggctctgcactccatgatgaagcagaaagaacgctttgccgccctagccaagttcaagtccagcatctaccggatcctgatcgcaacagacgtggcctcccggggcctggacatccctacggtacaggtggtcatcaaccacaacacccccgggctccccaagatctacatccaccgagtcggccggacggcccgtgcagggcggcagggtcaggccatcacgctggtgacacagtacgacatccacctggtgcacgccatcgaggagcagatcaagaagaagctggaggagttctccgtggaagaggccgaggtgctacagatcctcacacaggtcaacgtggtgcgaagagagtgtgagatcaaactggaggcggcccactttgacgaaaagaaggagatcaacaaacggaagcagctgatcctggaggggaaggaccctgacctggaggccaagcgcaaggctgagctggccaagatcaagcagaagaaccggcgcttcaaggagaaggtggaggagacgctgaagcgacagaaggctggcagggctggccacaaggggcgtccacccaggacaccgtctgggtcccactcaggcccagtcccctcccagggcctggtctgagccccacacggccatctgcccagtccttgactcgtccatggagctgagggtcggaggaaccttccttgggggcagcagcccttcccgggggcctacccagtgccccacagcagaacccgtgggcgctcgtgttgtgcgggccctgctcctctgccccgaaaccactggctggtcccttccctgagccctggccaagattcaggctgcaggggaagaaagaacatgaccgggaggttgtgaccccaacccaaggtcaccccccaggggtgccgcatacaggaggtgcttaataaacgggtcttttgacttcctcagtc

SEQ ID NO: 125473 - DNA, 2538 bp, Homo sapiens
  Payload ID: 4598
  Gene Symbol: DDX50
  Gene Name: DEAD (Asp-Glu-Ala-Asp) box polypeptide 50
  Uniprot ID: Q9BQ39
  ENST ID: ENST00000373585
  CDS Start-End: 108-2321
gcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttacgctgctgttgattttttccgaccatcagctcagagactgatagaagagaaaggtgcagtggatgcattggctgcagctttagcccacatttctggtgcatcaagctttgaaccacgatctttgatcacctctgataaggggtttgtgaccatgactctggaaagcctagaggaaatacaggatgtcagctgtgcttggaaagaacttaacagaaagctgagtagtaatgcagtgtctcagattaccagaatgtgcctcctgaaaggaaatatgggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 125474 - DNA, 888 bp, Homo sapiens
  Payload ID: 4598
  Gene Symbol: DDX50
  Gene Name: DEAD (Asp-Glu-Ala-Asp) box polypeptide 50
  ENST ID: ENST00000471475
  CDS Start-End: 69-224
tttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagctttatggatatcgcaatttcggataagggattatggacctgtacttcccttatagggttgttatgaagatttaaacaagataagctgaaaacacattacacagtgctggagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactagg

SEQ ID NO: 125475 - DNA, 1067 bp, Homo sapiens
  Payload ID: 4598
  Gene Symbol: DDX50
  Gene Name: DEAD (Asp-Glu-Ala-Asp) box polypeptide 50
  ENST ID: ENST00000483593
  CDS Start-End: 100-219
aaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagggttgttatgaagatttaaacaagataagctgaaaacacattacacagtgctggagtgacagaaggaagtcaaggcaccattatgactcggatgagaaatcagaaacaagagaaaatggtgttacagatgacctggatgctcccaaggccaaaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaatttgaattttacatattggtggcatttctctcttctcacagttaatcatattcgaaatggtattgacatcttggttggaacacctggtcgtatcaaagaccatctgcagagtggccgattggatctttctaaactgcgacatgttgtgcttgatgaa

SEQ ID NO: 125476 - DNA, 2510 bp, Homo sapiens
  Payload ID: 4598
  Gene Symbol: DDX50
  Gene Name: DEAD (Asp-Glu-Ala-Asp) box polypeptide 50
  ENST ID: ENST00000610822
  CDS Start-End: 97-2289
gccgggcggccgccttgcccccgcttcctttcacgctgtcgctgcccgtaggtggttgtggccactgtgcccggagggaggcggcggtggccagtaatgcctgggaaactcctctggggggacattatggagctggaacacccttggaggagtccgagagccagaagaaggagaggcaaaagagtgacagaaggaagtcaaggcaccattatgactcggatgagaaatcagaaacaagagaaaatggtgttacagatgacctggatgctcccaaggccaaaatctaaaatgaaagagaagctaaatggagacactgaagaaggatttaatagactttcagatgaattctccaaatctcataagtcaagaagaaaagatctaccaaatggagatatagatgaatatgaaaaaaaatcaaagcgagtatcatctttagatacttctactcataaatcaagtgataataaactagaggagaccttaacacgtgaacagaaagaaggagccttctccaattttcctatttctgaagagactataaagcttctgaaaggtcgaggggtaacatatctctttcctattcaagttaagacctttggtcctgtatatgaaggaaaagatttaatagctcaagcacggacaggaacaggaaagacattctcttttgccatccccttaattgaaagactccaaagaaatcaagaaacaattaaaaaaagccgctcaccaaaggtacttgttttggctccaacaagggaactggcaaaccaagtagccaaagacttcaaagatataactaggaaactcagcgtggcgtgtttttatggtggaacatcatatcaaagccaaattaatcatattcgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaatacatgaaatccagatatgaacaggttgaccttgttggaaaaatgactcaaaaggctgcaactactgtggaacatttggccatccagtgtcattggtctcagaggccagcagttattggagatgtccttcaagtctacagtgggtctgaagggagggctattattttctgtgagaccaagaagaatgtaactgaaatggccatgaatccacacataaaacagaatgcccagtgtttacatggggacattgcacagtcacaaagagaaattacactaaaaggcttcagagaaggtagttttaaagttttggtggcaaccaatgtggctgcccgtggtttggacattcctgaagttgacctggtgattcaaagttctcctcctcaggatgttgagtcctatatccatcgctctggacgcacaggtagagctggacggacagggatttgtatatgtttttatcaaccaagagaaagaggtcaactaagatatgtggaacaaaaagcaggaattacttttaaacgtgtaggtgttccttctacaatggatttagttaaatctaaaagcatggatgccatcaggtctctggcttccgtttcttacgctgctattttttccgaccatcagctcagactgatagaagagaaaggtgcagtggatgcattggctgcagctttagcccacatttctggtgcatcaagctttgaaccacgatctttgatcacctctgataaggggtttgtgaccatgactctggaaagcctagaggaatacaggatgtcagcttggaaagaacttaacagaaagctgagtagtaatgcagtgtctcagattaccagaatgtgcctcctgaaaggaatatggggtgtttgctttgatgttcctacaactgagtcagaaaggttacaggcagagtggcatgattccgactggatactctcagtgccagccaaattacctgaaattgaagaatattatgatggaaacacatcttctaattccagacagaggagtggctggtcaagtggtcgatcaggccggtcaggccggtcaggtggtcgatctggcggccggtcaggtagacagagtcgacaaggaagtcgctcaggaagtcgacaagatggtagaagacgaagtgggaatagaaatcgatcaagaagtgggccacaaacggagttttgactgagtatttgatagttaatctaccagtgtgagcttgcctatttctgcctaatcatgtacattatccaccaaaaattaggtcatcatagttgaggtatgtgtctgctatttgcaaagaagttggtcgtatttttttaaaaagtatttcacaagaatggaacaaatctacttatccagttatacctttgaataaaaaaacctccttttattgtctcttttca

SEQ ID NO: 125477 - DNA, 4718 bp, Homo sapiens
  Payload ID: 4599
  Gene Symbol: DDX51
  Gene Name: DEAD (Asp-Glu-Ala-Asp) box polypeptide 51
  Uniprot ID: Q8N8A6
  ENST ID: ENST00000397333
  CDS Start-End: 40-2040
gcagcgcgccacgcccgagtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcggcggcggcgggtgaacgacgcggagccggggagcccggaggcgccgcagggaaagcgacggaaggcggacggcgaggacgcgggcgcagaaagcaacgaggaggcgccaggggagcccagcgcagggagcagcgaggaggcgccaggggagcccagcgcagggagcagcgaggaggcgccgggggagcgcagcaccagcgccagcgccgaggcggccccagatggaccggccctggaggaggcggccggacccctggtccccggcctggtgctgggggggttcgggaagaggaaggcgccgaaggtccagcctttcctgccaaggtggctggctgagcctaactgtgtcagaaggaatgtcaccgaagacctggttcctatcgaggacatccctgacgtccatcctgacctgcagaagcagctgcgggcacacggcatctcgtcctactttccagtccaggcagctgtgattcctgccctcctggagagcgcagcctgtgggtttctggtgggcagaggtggctaccggcctagcgacctctgtgtttctgccccaacaggcagtgggaagacactggccttcgtcatccctgtggtgcaggccctgctttcgagagtggtctgccacatccgtgccctggttgtgctgcccaccaaggagctggcccagcaggtgagcaaagttttcaacatctacacagatgccacacctctgagagtctccctggttacgggacagaagtctctggccaaggagcaggagagcctcgtccagaaaacagctgatgggtaccgctgcttggctgacatcgtggtagccacccccggccgcctggtggaccacatcgaccagaccccaggattcagcctccagcagctccgcttcctgattatcgacgaggctgaccggatgattgacagcatgcatcagtcctggctgccgcgggtggtggcggccgccttccagagcgaggaccccgcggacccctgtgccctgctccagcgaaggcaggcccaggctgtgacagccgccagcacctgctgtccccagatgcccctgcagaagctgctcttctcagctactctgacccagaaccctgaaaagctgcagcagctgggcctccaccagccccggcttttctccacagggctagcacacaggggcctggaagatacagatggggacggggattcggggaagtatgcctttcctgttgggctcacgcaccactacgtgccctgcagcctcagctctaagccgctggtcgtcctgcacctggtcctggagatgggcttctcgagggttctctgcttcactaactcccgagagaactcccacaggctcttcctgctggtgcaagcttttgggggtgtggacgtggctgagttctcctcgcgctacgggcctggccagaggaggatgatcctgaagcagtttgaacaggggaagatccagctgctcatcagcacggacgccaccgcgcgaggcatcgacgtgcagggtgtggagctggtggtgaactacgacgccccccagtacctgagaacctacgtgcaccgggttgggaggacagctcgcgctgggaaaactggacaggccttcacactgctcctgaaagtgcaggagaggagattcctccgaatgctaactgaagctggggcacctgagttgcagcggcacgagctctccagcaagctgctgcagccgctggttcctcggtacgaggaggccctgtcccagctggaggagtctgtcaaggaagagcgcaagcagagggcggcctaggctggggctcagagggccggagggactgaacgctcaccaccctgaccctccttccagagcagtgctgatcactggatcctgtatgtgaggaaaggaatcccccagtggacacagccttcctccccaagcacgtggtctctgcgccaggcagcccgggcgtcagagctcaagcacctgccccgactggagacttcagggcttgtcactttcagagtgtggaggtcaggatggctgcgggcaatgaagccttagtaaaacggtgaaaagtactcccagacggacgcgggcacccgtcatgcttttgctgagagttgggggcattaaccttgagctaatgttaaaaatcaagctcttggccaggcatggtggctcatgcctgtaattccagcactttgggaggccaaggcgggtggatcacctgaggtcacgagttcgagaccagcctgaccaacatggagaaaccctgtctctactaaaaatacaaaattagccaggcgtggtggtgcatgcctgtaatccagctacttgggaggctgaggcaggaaaatggcttgaacccgggaggtggaggttgcagtgagctgagattgcgccactgcactccagcctgggcaacaagagcaaaactccgtctcaaaaaaaaaaattgccgggcgcggtggcaaatgcctgtaatcccagcactttgggaggccgaggcaggtggatcacaaggtcaggagatagagaccatcattgctaacatggtgaaaccccgtctctactaaaaatacaaaaaaaaaaaaaaaacaactagccgggcgtggtggcgggcacctatagtcccagctactcgggaggctgaggcaggagaatggcgtgaacccgggaggcggagcttgcagtgagcggagactgcgccactgcactccagcctgggcaacagagtgagactccgtcaaaaaaaaagctctcctccccagatttgtgaaccttgtgactgttcagtggacacctcacatattgctggtgggaaggtcacgtggagacagctgggcaaagccttggggcgttaaacacagagtcactcatgacccagcacttcctctcctatgcaccttgtacaccccagatcaatgaaacctacatccacacagaaacgtacacaaatctctcagcagcactgttcacagtagccaaaaactagaaaccacatgtccgtcagctgatgaatggagaataaaacgtgggaaatccacaccaggagagaaaaaggagtgaggcaccagcataggcaccccgtggatgaacccggaacctgacgctaactgaaggaaggctccggctatagggagtgtcccaggcacagccagagattgaagggtgccggggccgggagttggtgggggttggggctggggacacagtggccagtgtgtgggtttgttttggggatgatgaaaatgttcttaggttgtgtgtggtgatggctgctcacctctataaaccttttactaaaaaccatggactgggtggatacagtgtgtgaattctctcagtccagtgctttgtttgaaaaaggtggatgatgccaacatcactaaccgccagggagacgcaggccacggccacacccggctcactggagttgtgaggatggaaacaccagcccaccccactcagttcagacctcagcttagatgcaaagaatgtctgggatggggactggcagctgattagagatgcaaccactgaacctgtggactgtgttcaaacaaatgccagcagaacacaaaaggcgactgttacaggaggcagaaagaaatgatttaggtagacggggtaaagccagtccccagcagaaaatttgccttttaacaaaaagcagctcaaaaatagctccctttctaacctcggggttcaaaatcacttctcacgacaagcagccagaaagagcagactgtgaatcacagatgagacagctcgggcacaggagtgcggggggtgtctcctgggtgatcaccaaacttcacacttccacaatgggccccagtaaaacagtggaccctaataagcacattcccgtccccttaggtgcactaagggaagctaaaagcagactgaggggtgcctgtaaccccaagaagatgtctgggagcagacccagagaccctcgcagaaaagtgtcacagagcagcacagactgagtctgacagaaactctctatacaaatagcacaccttgtcccagctaaaaccctgggccctgggaggacaagacatccctcctctaacccctcgtcactagcccatttgtaaaaaccttgacaggccgggcacggtggctcacacctgtaatcccagcactttgggaggctgaggcaggcgcatcacctgaggtcaggagatcgagaccatcctggccaacatggtgaaaccccatctctactaaaaatacaaaacttagctgagcgtggtggcgtgtgcctggagtcccaactactcaagaggctgaggcaggagaatcacttgcccgggaggtggaggttgcagtgggccaagatcagcccactgcactgcagcctggcgacagaaaaaaaagaaaccttgacatctttactacaacttagcaacccgctcaggccccctctgcaacggagagctcttcttcctttttgcttattaaacttctgctccaaa

SEQ ID NO: 125478 - DNA, 776 bp, Homo sapiens
  Payload ID: 4600
  Gene Symbol: DDX52
  Gene Name: DEAD (Asp-Glu-Ala-Asp) box polypeptide 52
  ENST ID: ENST00000613633
  CDS Start-End: 14-319
tttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctat

SEQ ID NO: 125479 - DNA, 6362 bp, Homo sapiens
  Payload ID: 4600
  Gene Symbol: DDX52
  Gene Name: DEAD (Asp-Glu-Ala-Asp) box polypeptide 52
  Uniprot ID: Q9Y2R4
  ENST ID: ENST00000617633
  CDS Start-End: 45-1844
agtctgcgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgtagtggctcatgcctgtaatcctaacacttcgggaggcctaggcgggcaggttgtctgagctcaggagtttagagaccagcccgggcaacatggcaaaaccccatctctactaaaaaaaataccaaaaaaagttagccgggtgtggtggcatagtcccggctactcaggagtctgaggcaggagaatagcttgaacctgtgaggcggaggttgcagtaagccgagatcgcgctactgcactccagcctgggcgacagggcaagactgtcttgaaaataaacacacacacacacattatatatattatgtattatatatattagatatatattttttcttcaataaattaaccttagcttactgtaacttttactttatgagtttttttgttttgtttttttttttttttttgagaaacagggtctgttacctaatttggagtttagtggcacaatcatggcccactgcagccttgacctcttagactcaagtgatcctcaaacctcagcctcccgagtagctggtactataggtgcgggccaccaacactcagctaatttttaaattttgtagagacgaggtcttgcttgttgtccagttgggttttttagatttttttttttttttttttttggagatggagtcttgctctgttgcccaggctggagtgcagtggcatgatctcggctcactgcaacctctgactcctgggttcaagtgattctcctgcctcagcctcccgagttgctgggactacaggcatgcgccaccacacccagctaatttttgtatttttagtgacagggtttcaccatgttggccaggctggtctcaaactcctgacctggagtgagccactatatccggcctttataaacttttttgattcttgtcataacacttagcctaaaatgcaaatgtacagctgtagaaaaatactttatttctttatatccttattctagaagctttttttctattaatttttgtttgtttgttttgttttactatttacttctaaaacttttttgttaaaaaccatggcacaaacacacacattatgctaggcatacaaaaggtcaggatcatcagtctcactgtcttccacccccacttctcatcccaccattgtatctgctgtctgtggctgaccaaaacatcatcatgtagcacatgactagtgtggcaagtgctctgttagatgtaaggccatgatgctaaagcatcacaagagggcatctaacccagattggggatgtcatggaaggccgacatcctgagttgaatcctgcaaatgtaaaaaccaataggcaaagaagaggaacaaaaaggattccaggacaaactgaggtcacatctatgatccttgactttattgtgtctgtttaaagtatctacagtaacctgtatcaacttagtcagtgtattaatactaaatttagctccttcaaagcagttggaactatgtgctacataaatttcagcttcacacaaggaagggaaggagtgaaattagtgaacaggcagttacagcaaaagaaaaaacataaaaattgaatagctggctctggtgaaatgagcaaggactttagagtcaaactggcctggatttgaatcctgatcctcattgcttgtagctgtatgatctggacaaatgacagtaactgtttctaaccttgattttctcatctgtaagatgccaattgtaactcctaaggatactgaggattttttaaaatgcgtgtacagttcctgaccagtggtttgtgcctaataacttattacaaattattacccagtaaaaaccttgagacaagagtgaaaacgtaaagctaattaatccattacttgttagcaagcaaactacgtgcttgagaaaattactcaactttcatgttttacttccagacagtagtttgattaaaagaaaaaaaaaaatcacagcccaggcatgtggctcacaccctggcacttggaggccgaggtgggagcatagcttgagcctagcagtttgaaactagcctgggcaacatagatcctatctctacaaaaaaaaaaaaaaaaaaaaaaaaaaaaattggcccggtgtggtggtgcatgcctgtggtcccagctactcaggaggctgaggcgagaggatcgcttgagccagggaggctgaggctgctgtgagccatgatcatgccactgcactccagcctggacaacagagcaagaccctgtctcaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaaca

SEQ ID NO: 125480 - DNA, 6359 bp, Homo sapiens
  Payload ID: 4600
  Gene Symbol: DDX52
  Gene Name: DEAD (Asp-Glu-Ala-Asp) box polypeptide 52
  Uniprot ID: Q9Y2R4
  ENST ID: ENST00000615769
  CDS Start-End: 45-1844
agtctgcgcaggcgccgtagaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcaggatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccatgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgtagtggctcatgcctgtaatcctaacacttcgggaggcctaggcgggcaggttgtctgagctcaggagtttagagaccagcccgggcaacatggcaaaaccccatctctactaaaaaaaataccaaaaaaagttagccgggtgtggtggcatagtcccggctactcaggagtctgaggcaggagaatagcttgaacctgtgaggcggaggttgcagtaagccgagatcgcgctactgcactccagcctgggcgacagggcaagactgtcttgaaaataaacacacacacacacattatatatattatgtattatatatattagatatatattttttcttcaataaattaaccttagcttactgtaacttttactttatgagtttttttgttttgttttgttttttttttttgagaaacagggtctgttacctaatttggagtttagtggcacaatcatggcccactgcagccttgacctcttagactcaagtgatcctcaaacctcagcctcccgagtagctggtactataggtgcgggccaccaacactcagctaatttttaaattttgtagagacgaggtcttgcttgttgtccagttgggttttttagacttttttttttttttttttttggagatggagtcttgctctgttgcccaggctggagtgcagtggcatgatctcggctcactgcaacctctgactcctgggttcaagtgattctcctgcctcagcctcccgagttgctgggactacaggcatgcgccaccacacccagctaatttttgtatttttagtgacagggtttcaccatgttggccaggctggtctcaaactcctgacctggagtgagccactatatctggcctttataaacttttttgattcttgtcataacacttagcctaaaatgcaaatgtacagctgtagaaaaatactttatttctttatatccttattctagaagctttttttctattaatttttgtttgtttgttttgttttactatttacttctaaaacttttttgttaaaaaccatggcacaaacacacacattatgctaggcatacaaaaggtcaggatcatcagtctcactgtcttccacccccacttctcatcccaccattgtatctgctgtctgtggctgaccaaaacatcatcatgtagcacatgactagtgtggcaagtgctctgttagatgtaaggccatgatgctaaagcatcacaagagggcatctaacccagattggggatgtcatggaaggccgacatcctgagttgaatcctgcaaatgtaaaaaccaataggcaaagaagaggaacaaaaaggattccaggacaaactgaggtcacatctatgatccttgactttattgtgtctgtttaaagtatctacagtaacctgtatcaacttagtcagtgtattaatactaaatttagctccttcaaagcagttggaactatgtgctacataaatttcagcttcacacaaggaagggaaggagtgaaattagtgaacaggcagttacagcaaaagaaaaaacataaaaattgaatagctggctctggtgaaatgagcaaggactttagagtcaaactggcctggatttgaatcctgatcctcattgcttgtagctgtatgatctggacaaatgacagtagctgtttctaaccttgattttctcatctgtaagatgccaattgtaactcctaaggatactgaggattttttaaaatgcgtgtacagttcctgaccagtggtttgtgcctaataacttattacaaattattacccagtaaaaaccttgagacaagagtgaaaacgtaaagctaattaatccattacttgttagcaagcaaactacgtgcttgagaaaattactcaactttcatgttttacttccagacagtagtttgattaaaagaaaaaaaaaaatcacagcccaggcatgtggctcacaccctggcacttggaggccgaggtgggagcatagcttgagcctagcagtttgaaactagcctgggcaacatagatcctatctctacaaaaaaaaaaaaaaaaaaaaaaaaattggcccggtgtggtggtgcatgcctgcggtcccagctactcaggaggctgaggcgagaggatcgcttgagccagggaggctgaggctgctgtgagccatgatcatgccactgcactccagcctggacaacagagcaagaccctgtctcaaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaaca

SEQ ID NO: 125481 - DNA, 3123 bp, Homo sapiens
  Payload ID: 4600
  Gene Symbol: DDX52
  Gene Name: DEAD (Asp-Glu-Ala-Asp) box polypeptide 52
  ENST ID: ENST00000620209
  CDS Start-End: 26-364
gaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagagacagggtttcaccatgttagccagtatggtctcgatctcctgacctcgtgattcacccaccttgggctcccaaagtgctgggattacagatgtgagccaccacgcccagccagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagc

SEQ ID NO: 125482 - DNA, 2951 bp, Homo sapiens
  Payload ID: 4600
  Gene Symbol: DDX52
  Gene Name: DEAD (Asp-Glu-Ala-Asp) box polypeptide 52
  ENST ID: ENST00000616646
  CDS Start-End: 1-346
caactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgtagtggctcatgcctgtaatcctaacacttcgggaggcctaggcgggcaggttgtctgagctcaggagtttagagaccagcccgggcaacatggcaaaaccccatctctactaaaaaaaataccaaaaaaagttagccgggtgtggtggcatagtcccggctactcaggagtctgaggcaggagaatagcttgaacctgtgaggcggaggttgcagtaagccgagatcgcgctactgcactccagcctgggcgacaggagcaagaccctgtctcaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaacaataaaagaacaccagtgtacccaccgtatagtttaaaaa

SEQ ID NO: 125483 - DNA, 2027 bp, Homo sapiens
  Payload ID: 4600
  Gene Symbol: DDX52
  Gene Name: DEAD (Asp-Glu-Ala-Asp) box polypeptide 52
  ENST ID: ENST00000612255
  CDS Start-End: 27-320
agaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcaggtgaatgatgaactgtacatccattacaatggaatactacctagtaataaaacgaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcagaatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccgtgagagaacttgttaaaaagggtttcaatccacctgttcttgtttttgttcagtccattgaaagggctaaagaactttttcatgagctcatatatgaaggtattaatgtggatgttattcatgcagagagaacacaacaacaggtaaagtcaaatatatactttgaaactcagaagaactacttgattttaaactattgacattaaatttatgaagtacctgttttcattctaaaacaatttaatatatattctgttaaccagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtgagttgtcttttttttccttcccctctgtcacccactgatctgtcttaggacccctgctattccctgcacatatgctcacttcttagtgctgtgaaaatccagtgacttttataaatgaattttgagagcctccttccccccaaaatgtgttttttaatggtctaatttttcttaggtcgaactggaagagcagggaataagggaaaagcaattacatttttcactgaggatgataagccattattaagaagcgttgctaatgttatacagcaggctgggtgtcctgtaccagaatacataaaaggttttcagaaactactaag

SEQ ID NO: 125484 - DNA, 776 bp, Homo sapiens
  Payload ID: 4600
  Gene Symbol: DDX52
  Gene Name: DEAD (Asp-Glu-Ala-Asp) box polypeptide 52
  ENST ID: ENST00000632030
  CDS Start-End: 14-319
tttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcaggatacacatgatccacaaagcagcagtggcagccaagaaatttggacctaaatcatctaaaaagtttgatattcttgtgactactccaaatcgactaatctat

SEQ ID NO: 125485 - DNA, 3123 bp, Homo sapiens
  Payload ID: 4600
  Gene Symbol: DDX52
  Gene Name: DEAD (Asp-Glu-Ala-Asp) box polypeptide 52
  ENST ID: ENST00000633389
  CDS Start-End: 26-364
gaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcagagacagggtttcaccatgttagccagtatggtctcgatctcctgacctcgtgattcacccaccttgggctcccaaagtgctgggattacagatgtgagccaccacgcccagccagaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcaggatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccatgagagaacttgttaaaaagggtttcaatccacctgttcttgtttttgttcagtccattgaaagggctaaagaactttttcatgagctcatatatgaaggtattaatgtggatgttattcatgcagagagaacacaacaacagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagc

SEQ ID NO: 125486 - DNA, 2027 bp, Homo sapiens
  Payload ID: 4600
  Gene Symbol: DDX52
  Gene Name: DEAD (Asp-Glu-Ala-Asp) box polypeptide 52
  ENST ID: ENST00000633356
  CDS Start-End: 27-320
agaactgtggcgctttctgggtaaagatggacgtccacgatctctttcgccggctcggcgcgggggccaaattcgacacgagacgcttctcggcagacgcagctcgattccagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcaggtgaatgatgaactgtacatccattacaatggaatactacctagtaataaaacgaaattgcttcccaagaagaaggtgctactatacagtggatgtcatctgtagaagcaaagattgaagacaaaaaagttcagagagaaagtaaactaacttccggaaagttggagaatctcagaaaagaaaagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatggtcgggaacttctggcttctgctccaactggatctggaaaaacattagcttttagcattcctattttaatgcagctgaaacaacccgcaaataaaggcttcagagccctgattatatcaccaacacgagaacttgccagccagattcacagagagttaataaaaatttctgagggaacaggattcaggatacacatgatccacaaagcagcagtggcagccaagaaatttggacctaaatcatctaaaaagtttgatattcttgtgactactccaaatcgactaatctatttattaaagcaagatccccccggaatcgacctagcaagtgttgagtggcttgtagtagacgaatcagataaactgtttgaagatggcaaaactgggttcagagaccagctggcttccattttcctggcctgcacatcccacaaggtccgaagagctatgttcagtgcaacttttgcatatgatgttgaacagtggtgcaaactcaacctggacaatgtcatcagtgtgtccattggagcaaggaattctgcagtagaaactgtagaacaagagcttctctttgttggatctgagaccggaaaacttctggccatgagagaacttgttaaaaagggtttcaatccacctgttcttgtttttgttcagtccattgaaagggctaaagaactttttcatgagctcatatatgaaggtattaatgtggatgttattcatgcagagagaacacaacaacaggtaaagtcaaatatatactttgaaactcagaagaactacttgattttaaactattgacattaaatttatgaagtacctgttttcattctaaaacaatttaatatatattctgttaaccagagagataacacagtccacagtttcagagcaggaaaaatctgggttctgatttgtacagccttgctagcaagagggattgattttaaaggtgtgaacttggtgatcaactatgactttccaactagctcagtggaatatatccacaggataggtgagttgtcttttttttccttcccctctgtcacccactgatctgtcttaggacccctgctattccctgcacatatgctcacttcttagtgctgtgaaaatccagtgacttttataaatgaattttgagagcctccttccccccaaaatgtgttttttaatggtctaatttttcttaggtcgaactggaagagcagggaataagggaaaagcaattacatttttcactgaggatgataagccattattaagaagcgttgctaatgttatacagcaggctgggtgtcctgtaccagaatacataaaaggttttcagaaactactaag

SEQ ID NO: 125487 - DNA, 2952 bp, Homo sapiens
  Payload ID: 4600
  Gene Symbol: DDX52
  Gene Name: DEAD (Asp-Glu-Ala-Asp) box polypeptide 52
  ENST ID: ENST00000631762
  CDS Start-End: 1-346
caactatgactttccaactagctcagtggaatatatccacaggataggtcgaactggaagagcagggaataagggaaaagcaattacatttttcactgaggatgataagccattattaagaagcgttgctaatgttatacagcaggctgggtgtcctgtaccagaatacataaaaggttttcagaaactactaagcaaacaaaagaaaaagatgattaagaaaccattggaaagggagagcattagtacaactccaaaatgtttcttagaaaaagctaaggataaacagaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttcctgtagagatgagggtcttgccatgttgtccaggctggtcttgaactcctgacctcacacaatcctcctgccttagcctcctgagtaactgagattacaggcacaagctgctgcacccagctctgtaggtgacttttaaatgattatacaatggaaataacattcattgacatttctgtggtttgaatccagagagatacttcttatagaaaaacaaatgtttatgctaaaaataacaccaaaatgtggtgaactcttaaggacttttcccttcaagtgtgaaggaaggtgtgatgaatgctgtggagaggcatctggaacagaaattcaaaataaagccttgacattaaataccccttccactgctcactttgtggatggtagcatgagctgtctaccaagaagaaacctgctgctctcttaattttaatatttcctaatttgttgatggccttttgtgttgtgaaccacaacaaagagaggcctcttttgtggctggttattccagttccctgggattttaaattctttggtctattaagtatccttgtattggatacgtaataccttagtgctgtcataatgttgtacaagatcatgatcagcttctccctttcttcattttctgtgatttaaccatgttctttcctgtctctttccatttaagatattttatttgaatactgataaacattttatcctgataaggaagaatgttcttgttacttgatatacctctgtcttcattctcttacagcttatctttccttaggttgatggtgcctcatttaataagtagatctctacttaagctaaaggattatgatcatatggtgttggagactattagctattagatttttctcaaaatatgagttttgtacaatggaatgaaaaagtgacttcatatacgtaagactggtgcctaagaatgacttgaatgttatcagtactaccacagaactataatatacattgccttttctcagcagcatttgaattcaacttatttatttcctctatttgtagctttttgttctagagtcagaacaggtggactttgctttgaatattttagatgggacaaaaattgttcatcttcggaatttatttaaagaaagatctactggtacagggtgtaaaaatacttacaagaatatgatttttttgtttgttcatgcaaacagatcctttacccaatatatattctggaggtaggtatactggtgcaacccatttgccagctgtgtgactttgagtaagttcttaatttctcagagtttcagtgttctcatctataaaattatgtctccaattgtgagtacctagcactgtacctgatacatagtaaactcacaataaatatttcttaaacatagattttgttaggaatacaggcttgataacacagtccttacccttacaatgtaatgttagagataaaggagcaaatagagtcacgcatcacttaatgacagagatatgttctgagaaatgcatcgttaggtgatattgtcattgtgtaaacatcatgttgtttacttccacaaacctagatggtatagcctaccagtacacctaggctatatggtatagtctgttgctcctaggctacaaacccgtatagcatgttactgtcctgcatgctatagacagttggaacatgtagacttgtataaacactgcacacttaacctatactaaatttattgaaaatatttttcttggccaggcgtagtggctcatgcctgtaatcctaacacttcgggaggcctaggcgggcaggttgtctgagctcaggagtttagagaccagcccgggcaacatggcaaaaccccatctctactaaaaaaaataccaaaaaaagttagccgggtgtggtggcatagtcccggctactcaggagtctgaggcaggagaatagcttgaacctgtgaggcggaggttgcagtaagccgagatcgcgctactgcactccagcctgggcgacaggagcaagaccctgtctcaaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaacaataaaagaacaccagtgtacccaccgtatagtttaaaaa

SEQ ID NO: 125488 - DNA, 3629 bp, Homo sapiens
  Payload ID: 4601
  Gene Symbol: DDX53
  Gene Name: DEAD (Asp-Glu-Ala-Asp) box polypeptide 53
  Uniprot ID: Q86TM3
  ENST ID: ENST00000327968
  CDS Start-End: 98-1993
tcttttggtgcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcaggggcagcagaggcagtggctggagtggccccttcggccatcagggaccgagagcagcaggctcccgtgaaccaccactctgctttaaaataaagaacaatatggttggtgtggtcattggttacagtggatcaaaaataaaagatctacaacattcgacaaacactaaaatacagatcataaacggggaatctgaagcaaaagtcagaatttttggcaatagggaaatgaaagcaaaggccaaagcggctatagaaacacttattagaaaacaagaaagctacaactcagaatccagtgtggataatgctgcatcccaaacccctattggaagaaatctaggcagaaatgacattgttggagaagctgagccattgtcaaattgggatcgcattagggcagcagtcgtggagtgcgaaaagagaaaatgggcagatctaccaccagttaagaaaaacttttacatagaatccaaagcaacaagctgcatgtctgaaatgcaggtgattaactggagaaaggaaaatttcaacataacgtgtgatgacttgaaaagtggtgaaaagcgtctcattccaaaaccaacttgcaggtttaaagacgcttttcagcaataccctgatcttctgaaaagcataataagggtagggattgtaaagccaacgccaattcagtcacaggcatggccaattattctacaaggaatagatcttatagtagttgcacaaaccggaacagggaaaacattgtcctatctaatgcctgggtttattcatcttgattctcaaccaatatctagagagcaaaggaatgggcctgggatgctagtccttacacccactagagagttggctcttcacgtggaagctgaatgttcaaagtattcatataaaggtctcaaaagcatttgcatatatggtggtagaaacagaaatggacaaatagaagacattagcaaaggtgtagatatcattattgcaactcctgggaggctgaatgacctacaaatgaataactctgtcaacctaagaagcataacctacttggttatagatgaggcagataaaatgctggatatggaatttgaaccccagataaggaagattttattagatgtgcgcccagaccgacagactgttatgacaagtgcaacttggccagatactgtacgtcaactagcactttcttatttgaaagatcctatgattgtttatgttggtaatctgaatctagtggctgtaaatacagtgaagcaaaatataattgttaccacagaaaaagaaaaacgagctctcacccaagaattcgtagagaacatgtcacccaacgacaaagtcatcatgtttgtcagccaaaaacatattgctgatgacttgtcaagcgacttcaatatccaaggcatatctgcagaatcattacatggcaacagtgaacagagtgatcaagagcgagcagtagaggactttaaaagcggaaacataaagatactgattacaactgatatagtatcccgaggtcttgatcttaatgatgtcacacatgtatataattatgatttcccaaggaatattgacgtatatgtacacagagtagggtacattggacggacaggaaagactggcacatcagttaccctcatcactcagagagattcgaaaatggccggtgaattgattaaaattctggacagagcaaatcagagtgttccggaagatcttgtagtaatggctgagcaatacaagttaaatcaacaaaagaggcacagagaaacacgatcaagaaaacctggacaaagacgcaaggagttttattttttaagttgaaaagttgtaccaggctactggaagattccaggcatgttaaagatatgcagtattgaatatatgtaaggaagtattggaaacatactagccatttgaagacataactaattcttaaataatactgctaaactttcaatattgtgtatgctccttaattttaaaaaagtctcaaaaatgagagagtgagagactgtgtgaagagaaagtgaatgttacgtgttggttaaagtttaatttctcttaaaaatacttttattttaggtttgggggtatatgtgaaggtttgttaaagaaacacgtgccatgggggtttatcaactttcaatattgtgtatgttccttaattttagaaaaagtctcaaaaatgagagagagactatgtgaagagaaggtaaatgttatgtgttggttaaagtttaatttctcctaaaaatacttttattttaggtttgggggtatttgtgaaggtttgttaaagaaacacgtgtcatgggggtttatcaactttcaatattgtgtatgctccttaattttaaaaaagtctcaaaaatgagagagtgagagactatgtgaagagaaagtaaatgttacgtgttggttaaagtttaatttctcttaaaaatacttttattttaggtttgggggtatatgtgaaggtttgttaaagaaacacgtgtcatgggggtttatcaactttcaatattgtgtatgttccttaattttaaaaaagtctcaaaaatgagagagtgagagactatgtgaagagaaagtaaatgttatgtgttggttaaagtttaatttctcttaaaaatacttttattttaggtttgggggtatatgtgaaggtttgttaaagaaacacgtgtcatgggggtttactgtacatattatttcgtcacccaggtattaagaccagtgcccaataattatcttttctgctcttctgcctccttccaccctcccccatcagctagaccccagtgtctgctgtttccttctttgcgttcataagttctcatcgtttgcttcccacttataagtgagaacatgtggtatttgagtttctgttcttgtgttaattttatagtctaccatgtccatttgtcttctctaaaacacttggtagaagacaacaatggtgcttttctggctttaaaatagttgtactaaattgaagcatagcttcaagcttatccagtcaaagtattctcttttcccccgagcagttggtgccacaacagttcttaaagttatttccactatcattctctacttgttttagttcattagaaaataagtgctaaattttttagaagattccacaattctatttttatcagaatgatgtcaccagcagagcaggatgtctgactcactgggattcaggtccttgtatgcattttgtcactaacccttggttaaaactctgaggaaatcacttgccttctctaggcctcaatttctctactcataaaatgggacagttttattaatttagaggtctcttttacctctaaaattcggtgacattataactaaaactgtataccccagccttgtattaacacttttttgtctaatctaggggaaattgcatccttgtataattgaataaaacaatccttttcaatgacaa

SEQ ID NO: 125489 - DNA, 4377 bp, Homo sapiens
  Payload ID: 4602
  Gene Symbol: DDX54
  Gene Name: DEAD (Asp-Glu-Ala-Asp) box polypeptide 54
  Uniprot ID: Q8TDD1
  ENST ID: ENST00000306014
  CDS Start-End: 29-2674
ccttctgcgttcccagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaact

SEQ ID NO: 125490 - DNA, 4380 bp, Homo sapiens
  Payload ID: 4602
  Gene Symbol: DDX54
  Gene Name: DEAD (Asp-Glu-Ala-Asp) box polypeptide 54
  Uniprot ID: Q8TDD1
  ENST ID: ENST00000314045
  CDS Start-End: 29-2677
ccttctgcgttcccagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaagacctccttcttcctcgtgcgggaggacaccaaggctgccgtgctgctccacctgctgcacaacgtggtgcggccccaggaccagaccgtggtgtttgtggccacgaagcaccacgccgagtacctcactgagctgctgacgacccagcgggtgagctgcgcccacatctacagtgccctagacccgacagcccgcaagatcaatctcgccaaattcacgcttggcaagtgctccactctcattgtgactgacctggccgcccgaggcctggacatcccgctgctggacaatgtcatcaactacagcttccccgccaagggcaaactcttcctgcaccgcgtgggccgtgtggctcgggctggccgaagtggcacagcctactccttggtggcccctgatgaaatcccctacctgctggatctgcacctgttcctgggccgctccctcaccctcgcccgacccctcaaggagccctcaggtgtggccggtgtggatggcatgctgggtcgggtgccacagagtgtggtggacgaggaggacagtggtctgcagagcaccctggaggcatcgctggagctacggggcctggcccgcgttgctgataacgcccagcagcagtatgtgcgctcacgcccggcgccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcgactatctttgagatcaacgcctccagccgagacctgtgcagccaggtgatgcgcgccaagcggcagaaggaccgcaaggccatcgcccgcttccagcagggacagcaggggcggcaggagcagcaggagggcccagtgggcccagccccgagccgcccagcactgcaggagaagcagcctgagaaggaggaggaggaggaggcgggagagagtgtggaggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgctacatcagcagctcctacaagcgagacctctatcagaagtggaaacagaaacagaaaattgatgatcgtgactcggacgaagaaggggcatctgaccggcgaggcccagagcgaagaggtgggaagcgagaccgtggccaagcaggtgcatcccggccccacgccccaggcacccctgcaggccgagtccgcccggaactcaagaccaagcagcagatcctgaagcagcggcgccgggcccagaagctgcacttcctgcagcgtggtggcctcaagcagctctctgcccgcaaccgccgccgcgtccaggagctgcagcagggcgccttcggccggggtgcccgctccaagaagggcaagatgcggaagaggatgtgaggaccaggacccagccccgtggctccttgattggccttagggtgggcatcagcagacgttcccgtgcaccactgtgtgcctggccctgtgctgggcactgggggcactccctgcaggagccatcatctgtgaaaaggagcactgtatggccacagaagggcagcagctgcgtcagcctaagacagagacatttgaacagggccttgaagggtgtgcaggagttcgccagcaaagccaggcaggccaagacttgagttggcaactcagctgctgctgcttccatgtgttctgggttcagaggtcatggctgcaccggtcagagccctgagtgcctcagggtttggcaatggaatttttaatgtaataaatctttattgagcactgctggtggccaggagtgcggtctacttggggaactggaatggagagacccaggtactaaaatcccagctaacgtggcagaggagttgcgggtctcctgagggtgagttctgctgccttgtccatttagcgatgaggaaagtgaagctcagagcacaaaccaggtgccagaggcgggagttggtcccccttcctcccactggacatggttgcagctgggagtgggctgggggaggggaacaggatgcccagcccagggggcaaggacacagctgctcccctctggctatgaagaggttaacgcggcccctccacacctggaggtcagaacctggcctgtcctctgtcttcttgccacccaccccctgtttgaggttctgagaaggtcaagggcagccccagcagctggattctcaggctgggcccctcacctggcagagtccatagtggagggggccttggtgatctctcatctagcatggaccctgttctgagacctgacaaagagttttttttcatgccccaaccaccctggcagggagggcctggtctgatctcattttagaggcagttgccccacacatagccccttgaccttcccatcacctcctcatcagggcctgcatttatggagtgcttgctatgtgcccctcatggcaggcccacagcactctgaacaggcacagccctcccatcttcccaatgaggaaacggattcaggaagagccactcagtccacaccccattggaaatgtgggccctcctatctcagggtctctcaggggttccctctcccgctgctcacctgtgtcagggctaggaggcaggggctgcaggctcagcctgacccaggccggccagcatggcagagaggtcctgcatgaacagcttcacctgggggggcccagcacgaagtcacatcccagccccagagtcactgtccagcccccacccctcaacacgcgggggaggccgaaaggtagggcggggactggagatcccctcattaaaagaacagtgatgatggtggttcccagaggtggtgactgagatcctaaaccgttctgggttttgaaagcctcaggccaaccttcccaactgctgcgtgagcagacaccttcacagcttcctcgctgctgtcacctgcactatccaattagtattttcatttacatcaatcagctttattttcttgtaactggatcagtcatattcattggtttgtgacctactcttatctccgtgggtggctctccttttgttttaattaacttctttatgaatatgaacttaataaataccatggatccattgtaaaaact

SEQ ID NO: 125491 - DNA, 479 bp, Homo sapiens
  Payload ID: 4602
  Gene Symbol: DDX54
  Gene Name: DEAD (Asp-Glu-Ala-Asp) box polypeptide 54
  ENST ID: ENST00000546898
  CDS Start-End: 1-479
gccctcgcctgagtccatcaagagggccaaggagatggaccttgtggggctgggcctgcaccccctcttcagctcgcgttttgaggaggaggagctgcagcggctgaggctggtggacagcataaagaactaccgctcccgggcggacattttctcagaggtcgtgggccggaagcggcagcggtcaggacccaacaggggagccaagaggcggagggaggaggcccggcagcgggaccaggaattctacatcccctaccggcccaaggactttgacagcgagcggggcctgagcatcagcggggaagggggagcctttgagcagcaggcagctggcgctgtcctggacttgatgggggatgaagcccagaacctgacgaggggccggcagcagctcaagtgggaccgtaagaagaagcggtttgtgggacagtcaggacaggaagacaagaagaagattaagacagagagcggccgct

SEQ ID NO: 125492 - DNA, 872 bp, Homo sapiens
  Payload ID: 4602
  Gene Symbol: DDX54
  Gene Name: DEAD (Asp-Glu-Ala-Asp) box polypeptide 54
  ENST ID: ENST00000551344
  CDS Start-End: 1-247
caagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcggatgtggagccggacacccgggagatggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctggcctcacggagcccgtgctcatccggcttgacgtggataccaagctcaacgagcagctgaa

SEQ ID NO: 125493 - DNA, 780 bp, Homo sapiens
  Payload ID: 4602
  Gene Symbol: DDX54
  Gene Name: DEAD (Asp-Glu-Ala-Asp) box polypeptide 54
  ENST ID: ENST00000552375
  CDS Start-End: 156-780
aaaaaagaaaaaaaaaaaaaagggagatcccatctttacaaaaaaagagagaaagcagcttgaccaagacctcacagcttctgggacctggaagacccctgcccaccttccccacctcggaatgcacctcggatgtggagccggacacccgggagatggtgcgtgcccagaacaagaagaagaagaagtctggaggcttccagtccatgggcctgagctacccggtgttcaaaggcatcatgaagaaggggtacaaggtgccaacacccatccagaggaagaccatcccggtgatcttggatggcaaggacgtggtggccatggcccggacgggcagtggcaagacagcctgcttcctcctcccaatgttcgagcggctcaagacccacagtgcccagaccggggcccgcgccctcatcctctcgccgacccgagagctggccctgcagaccctgaagttcactaaggagctaggcaagttcactggcctcaagactgccctgatcctgggtggagacaggatggaagaccagtttgcagccctgcacgaaaatcccgacataattattgccacgcccggacggttggtgcatgtggctgtggaaatgagcctgaagctgcagagtgtggaatacgtggtgttcgatgaagctgaccggctttttgaaatgggtttcgcagagcagctgcaggagatcatcgcccgcctccccgggggccaccagacggtgctgttctccgccacgctgcccaaactgctggtggaatttgcccgggctg

SEQ ID NO: 125494 - DNA, 2654 bp, Homo sapiens
  Payload ID: 4603
  Gene Symbol: DDX55
  Gene Name: DEAD (Asp-Glu-Ala-Asp) box polypeptide 55
  Uniprot ID: Q8NHQ9
  ENST ID: ENST00000238146
  CDS Start-End: 51-1853
gcacaaggcgcgttcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatattatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcctg

SEQ ID NO: 125495 - DNA, 1004 bp, Homo sapiens
  Payload ID: 4603
  Gene Symbol: DDX55
  Gene Name: DEAD (Asp-Glu-Ala-Asp) box polypeptide 55
  ENST ID: ENST00000354291
  CDS Start-End: 20-595
cgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaag

SEQ ID NO: 125496 - DNA, 1574 bp, Homo sapiens
  Payload ID: 4603
  Gene Symbol: DDX55
  Gene Name: DEAD (Asp-Glu-Ala-Asp) box polypeptide 55
  Uniprot ID: Q8NHQ9
  ENST ID: ENST00000421670
  CDS Start-End: 669-1292
ttttttttttttttttttgagacggagtttcactcttgttgcccaggctggagtgcaatggcactatctcggttcaccgcaacctccacctcccgggttcaatggattctcctgcctcagcctcccaagtagctgggattacaggcatgcgccaccccagctaattttgtatttttagtagagatggggtttctccatgttggtcaggctggtcttgaactcccgacctcaggtgatccgcccacctcggcctcccaaagtgctgggatgacaggcgtgagccaccgtgcccggccaccctggtgggctttaaggctgtggaggcacctcggtcatggagtgaccaagtctcctgtgtggtagcatgccctgctgggacccaggcaagggttacttcttgtgaatagagacccagtgttgccatactttgctaccagattaggattgtcatgtgaaatctgatttttaaattttcttttaaaaatttaacatactttacagagcatgtgaaatatttgggttggagttgggcttcagacctcaacagttgaaaaggaattgtttcgcttttgtttttcttggttgtgatggggagccctggggatatgatgccagccagggaaggtgagaatgtggtatgtgtgtgtgtgtagtgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagacc

SEQ ID NO: 125497 - DNA, 956 bp, Homo sapiens
  Payload ID: 4603
  Gene Symbol: DDX55
  Gene Name: DEAD (Asp-Glu-Ala-Asp) box polypeptide 55
  ENST ID: ENST00000544738
  CDS Start-End: 25-177
accgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaa

SEQ ID NO: 125498 - DNA, 1735 bp, Homo sapiens
  Payload ID: 4603
  Gene Symbol: DDX55
  Gene Name: DEAD (Asp-Glu-Ala-Asp) box polypeptide 55
  ENST ID: ENST00000538744
  CDS Start-End: 22-1731
gacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattcc

SEQ ID NO: 125499 - DNA, 799 bp, Homo sapiens
  Payload ID: 4603
  Gene Symbol: DDX55
  Gene Name: DEAD (Asp-Glu-Ala-Asp) box polypeptide 55
  ENST ID: ENST00000540763
  CDS Start-End: 22-150
gacgcggcgaaggagcgcgccatggagcatgtgacagagggctcctgggagtcgctgcctgtgccgctgcacccgcaggtgctgggcgcgctgcgggagctgggcttcccgtacatgacgccggtgcagggcttcgggtctcacctgtgaattgatggcatcctttaaccagtgctttgcaatctctctctttagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagacccc

SEQ ID NO: 125500 - DNA, 4089 bp, Homo sapiens
  Payload ID: 4604
  Gene Symbol: DDX58
  Gene Name: DEAD (Asp-Glu-Ala-Asp) box polypeptide 58
  ENST ID: ENST00000379868
  CDS Start-End: 504-2672
acagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacagtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaa

SEQ ID NO: 125501 - DNA, 4353 bp, Homo sapiens
  Payload ID: 4604
  Gene Symbol: DDX58
  Gene Name: DEAD (Asp-Glu-Ala-Asp) box polypeptide 58
  Uniprot ID: O95786
  ENST ID: ENST00000379883
  CDS Start-End: 159-2936
tagttattaaagttcctatgcagctccgcctcgcgtccggcctcatttcctcggaaaatccctgctttccccgctcgccacgccctcctcctacccggctttaaagctagtgaggcacagcctgcggggaacgtagctagctgcaagcagaggccggcatgaccaccgagcagcgacgcagcctgcaagccttccaggattatatccggaagaccctggaccctacctacatcctgagctacatggccccctggtttagggaggaagaggtgcagtatattcaggctgagaaaaacaacaagggcccaatggaggctgccacactttttctcaagttcctgttggagctccaggaggaaggctggttccgtggctttttggatgccctagaccatgcaggttattctggactttatgaagccattgaaagttgggatttcaaaaaaattgaaaagttggaggagtatagattacttttaaaacgtttacaaccagaatttaaaaccagaattatcccaaccgatatcatttctgatctgtctgaatgtttaattaatcaggaatgtgaagaaattctacagatttgctctactaaggggatgatggcaggtgcagagaaattggtggaatgccttctcagatcagacaaggaaaactggcccaaaactttgaaacttgctttggagaaagaaaggaacaagttcagtgaactgtggattgtagagaaaggtataaaagatgttgaaacagaagatcttgaggataagatggaaacttctgacatacagattttctaccaagaagatccagaatgccagaatcttagtgagaattcatgtccaccttcagaagtgtctgatacaaacttgtacagcccatttaaaccaagaaattaccaattagagcttgctttgcctgctatgaaaggaaaaaacacaataatatgtgctcctacaggttgtggaaaaacctttgtttcactgcttatatgtgaacatcatcttaaaaaattcccacaaggacaaaaggggaaagttgtcttttttgcgaatcagatcccagtgtatgaacagcagaaatctgtattctcaaaatactttgaaagacatgggtatagagttacaggcatttctggagcaacagctgagaatgtcccagtggaacagattgttgagaacaatgacatcatcattttaactccacagattcttgtgaacaaccttaaaaagggaacgattccatcactatccatctttactttgatgatatttgatgaatgccacaacactagtaaacaacacccgtacaatatgatcatgtttaattatctagatcagaaacttggaggatcttcaggcccactgccccaggtcattgggctgactgcctcggttggtgttggggatgccaaaaacacagatgaagccttggattatatctgcaagctgtgtgcttctcttgatgcgtcagtgatagcaacagtcaaacacaatctggaggaactggagcaagttgtttataagccccagaagtttttcaggaaagtggaatcacggattagcgacaaatttaaatacatcatagctcagctgatgagggacacagagagtctggcaaagagaatctgcaaagacctcgaaaacttatctcaaattcaaaatagggaatttggaacacagaaatatgaacaatggattgttacagttcagaaagcatgcatggtgttccagatgccagacaaagatgaagagagcaggatttgtaaagccctgtttttatacacttcacatttgcggaaatataatgatgccctcattatcagtgagcatgcacgaatgaaagatgctctggattacttgaaagacttcttcagcaatgtccgagcagcaggattcgatgagattgagcaagatcttactcagagatttgaagaaaagctgcaggaactagaaagtgtttccagggatcccagcaatgagaatcctaaacttgaagacctctgcttcatcttacaagaagagtaccacttaaacccagagacaataacaattctctttgtgaaaaccagagcacttgtggacgctttaaaaaattggattgaaggaaatcctaaactcagttttctaaaacctggcatattgactggacgtggcaaaacaaatcagaacacaggaatgaccctcccggcacagaagtgtatattggatgcattcaaagccagtggagatcacaatattctgattgccacctcagttgctgatgaaggcattgacattgcacagtgcaatcttgtcatcctttatgagtatgtgggcaatgtcatcaaaatgatccaaaccagaggcagaggaagagcaagaggtagcaagtgcttccttctgactagtaatgctggtgtaattgaaaaagaacaaataaacatgtacaaagaaaaaatgatgaatgactctattttacgccttcagacatgggacgaagcagtatttagggaaaagattctgcatatacagactcatgaaaaattcatcagagatagtcaagaaaaaccaaaacctgtacctgataaggaaaataaaaaactgctctgcagaaagtgcaaagccttggcatgttacacagctgacgtaagagtgatagaggaatgccattacactgtgcttggagatgcttttaaggaatgctttgtgagtagaccacatcccaagccaaagcagttttcaagttttgaaaaaagagcaaagatattctgtgcccgacagaactgcagccatgactggggaatccatgtgaagtacaagacatttgagattccagttataaaaattgaaagttttgtggtggaggatattgcaactggagttcagacactgtactcgaagtggaaggactttcattttgagaagataccatttgatccagcagaaatgtccaaatgatatcaggtcctcaatcttcagctacagggaatgagtaactttgagtggagaagaaacaaacatagtgggtataatcatggatcgcttgtacccctgtgaaaatatattttttaaaaatatctttagcagtttgtactatattatatatgcaaagcacaaatgagtgaatcacagcactgagtattttgtaggccaacagagctcatagtacttgggaaaaattaaaaagcctcatttctagccttctttttagagtcaactgccaacaaacacacagtaatcactctgtacacactgggatagatgaatgaatggaatgttgggaatttttatctccctttgtctccttaacctactgtaaactggcttttgcccttaacaatctactgaaattgttcttttgaaggttaccagtgactctggttgccaaatccactgggcacttcttaaccttctatttgacctctgcgcatttggccctgttgagcactcttcttgaagctctccctgggcttctctctcttctagttctattctagtctttttttattgagtcctcctctttgctgatcccttccaagggttcaatatatatacatgtatatactgtacatatgtatatgtaactaatatacatacatacaggtatgtatatgtaatggttatatgtactcatgttcctggtgtagcaacgtgtggtatggctacacagagaacatgagaacataaagccatttttatgcttactactaaaagctgtccactgtagagttgctgtatgtagcaatgtgtatccactctacagtggtcagcttttagtagagagcataaaaatgataaaatacttcttgaaaacttagtttactatacatcttgccctattaatatgttctcttaacgtgtgccattgttctctttgaccattttcctataatgatgttgatgttcaacacctggactgaatgtctgttctcagatcccttggatgttacagatgaggcagtctgactgtcctttctacttgaaagattagaatatgtatccaaatggcattcacgtgtcacttagcaaggtttgctgatgcttcaaagagcttagtttgcggtttcctggacgtggaaacaagtatctgagttccctggagatcaacgggatgaggtgttacagctgcctccctcttcatgcaatctggtgagcagtggtgcaggcggggagccagagaaacttgccagttatataacttctctttggcttttcttcatctgtaaaacaaggataatactgaactgtaagggttagtggagagtttttaattaaaagaatgtgtgaaaagtacatgacacagtagttgcttgataatagttactagtagtagtattcttactaagacccaatacaaatggattatttaaaccaa

SEQ ID NO: 125502 - DNA, 2289 bp, Homo sapiens
  Payload ID: 4605
  Gene Symbol: DDX59
  Gene Name: DEAD (Asp-Glu-Ala-Asp) box polypeptide 59
  Uniprot ID: Q5T1V6
  ENST ID: ENST00000331314
  CDS Start-End: 215-2074
aaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagattggaagagtaggaagattaggtcaaaatggaacagcgattactttcatcaataataattcaaaaagactcttctgggatattgcaaaacgagtaaagcccacaggatccattcttccccctcagttattaaattccccataccttcatgaccagaagagaaaggaacaacagaaagataaacagacacagaatgatctggttacaggagctaatcttatggatattatcagaaaacatgataaaagtaattctcagaaatgattttctctgccacttgaatatttttttttattgtatatagtcagcaaaaaattatggtttgcataaatggaaatgtacatgaattttaaaaattttaagatatttttaatttaataaaatttatataactatattgtatttatttcccttaattcttataaattaaaaacatcagaaaatgaattattaaataaaagacagtgttttcttttctg

SEQ ID NO: 125503 - DNA, 635 bp, Homo sapiens
  Payload ID: 4605
  Gene Symbol: DDX59
  Gene Name: DEAD (Asp-Glu-Ala-Asp) box polypeptide 59
  ENST ID: ENST00000436897
  CDS Start-End: 154-635
tggggcgctaggccgcggcggcagaactggtgcccctgcgcggccttcctcccatccttacagttccccgtgtcccaggcctctacccggaaccggagccccgcccgtctcctagcagctccgtgacgtgaagcgcctcgggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctcc

SEQ ID NO: 125504 - DNA, 945 bp, Homo sapiens
  Payload ID: 4605
  Gene Symbol: DDX59
  Gene Name: DEAD (Asp-Glu-Ala-Asp) box polypeptide 59
  ENST ID: ENST00000413408
  CDS Start-End: 1-618
tttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagctgaatattatttgggttgtgcccttctctggaattaatatcaacgcatctcttattgccttgttatacagtctactcaccacaatcaatatgaagtttactccataaacagaggtatggtacaagaggtaacgtgtcatccaaggtgactttcctggcagccaccagtaaactgactccggacagataggactcttttgttgccgccaaggcatacttacaatgacctcagaggctctagggccacagtgtgaaaaccaaccaatggataattaagtaaacacagttctcttgttctactgttagtgtgagaacctattttatattttataatgtgttgcacgtgtgatgatataggacaaaattacaaataaagcataagacgagtgtttatttttgtaatgtttacaaatagtaacttacaaataaatttta

SEQ ID NO: 125505 - DNA, 2900 bp, Homo sapiens
  Payload ID: 4605
  Gene Symbol: DDX59
  Gene Name: DEAD (Asp-Glu-Ala-Asp) box polypeptide 59
  Uniprot ID: Q5T1V6
  ENST ID: ENST00000447706
  CDS Start-End: 153-1895
gctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcaggaaaatacctacaagtctacttggaggaatccccagcattttcaacaggatgtcagaatgaccttgggctatgttggcaaagcacaatgggaagaagacaaccaattgaaggtcaaactaggccttaaaaaaaattgttcttcctaaatgaaactttatgtaagacccaagcttcctttatgtaaaaataggatactcactaggctttggggctgacaatggtttttaaatcttgctaatcttccctggaatgaaaccagcatgactcaaagagaaaaagagagtctataatattttctaatccctgagttcttttctttatatattaaaaaggattactaggctgggtgtggtggctcacgcctgtaatcccagcactttgggaggccgaggggagtggatcacctgagttcgagaccagcctaaccaacatggagaaaccctgtctctactaaaaatacaaaattagccaggcgtggtggcgcatgcctgtaatcccagctactcaggaggctgcggcaggagaattgcttgaactcgggaggcagagccaagatcgcaccactgcactccagcctgggcaacaagagtgaaactctgtctcaaaataatattaatgataataataataataataatagggattacttgcataattgttcttttaaaattattggcagtattgctgaatgtatttagattttttcaccaagtgacaacaactgaattcataaagattcatcaacaagacctgataaaaaaaaatgtaagcatattatagtggatacttccaagactcttggtctaacatgtattagaaagcagaaggagcccaggcacaggggctcccgccggtaatcccaaagctttgggaagccaaggcaggtggatcgcttgagctcaggagttagagaccagcctgggcaacatggtgaaatcccgtcaccacaaaaaaatgcaaaaattaactgggcgtggtggcatgcacctgtagtcccagctactctggaggctgaggtgaggggaatcacctgagccgggggaatcacctgagcccagggaagttgaggctgctgtgagccatggtcatgacactgccctccagcctggacaacagattgagaccctgtctcaaaaaaaaaaaaaaaaaaa

SEQ ID NO: 125506 - DNA, 643 bp, Homo sapiens
  Payload ID: 4605
  Gene Symbol: DDX59
  Gene Name: DEAD (Asp-Glu-Ala-Asp) box polypeptide 59
  ENST ID: ENST00000453944
  CDS Start-End: 419-643
aaaataggcattggggagtccctctgagccttttctggctcaggaggttgccgataaaattttaaaaaataaaataggcatcggaatccatgaaacgtatggtttctctaagggaggcaagttagaaatgagcagaaacagaggcaggggctagggctaagggcctggcttgtggagtctgaagatgagtcagtaaaaaagctgcttgagacaccagagaggaactgagaatgaataatatccttgaagaagagagaaccattgtttcaagaggaggatgaagatgcaaatagtcagaggagtcacctggcttgcttagtgaccatcagacgagaccagacctctcacttggatattctgattcagtaggtgtgagttggagccaggaatctctacaaactcattccaggctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaa

SEQ ID NO: 125507 - DNA, 725 bp, Homo sapiens
  Payload ID: 4605
  Gene Symbol: DDX59
  Gene Name: DEAD (Asp-Glu-Ala-Asp) box polypeptide 59
  ENST ID: ENST00000429498
  CDS Start-End: 1-592
cttacccttacccccacagctttatcgtctgcaacaacatgttaaggataagaaactctttaagcctccagtgttagtatttgtggactgcaaactaggagcagatcttttgagtgaagccgttcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagattggaagagtaggaagattaggtcaaaatggaacagcgattactttcatcaataataattcaaaaagactcttctgggatattgcaaaacgagtaaagcccacaggatccattcttccccctcagttattaaattccccataccttcatgaccagaagagaaaggaacaacagaaagataaacagacacagaatgatctggttacaggagctaatcttatggatattatcagaaaacatgataaaagtaattctcagaaatgattttctctgccacttgaatatttttttttattgtatatagtcagcaaaaaattatggtttgcataaatggaaatgtacatgaattttaaaaattttaagatatttttaatttaataaaatttatataactata

SEQ ID NO: 125508 - DNA, 889 bp, Homo sapiens
  Payload ID: 4605
  Gene Symbol: DDX59
  Gene Name: DEAD (Asp-Glu-Ala-Asp) box polypeptide 59
  ENST ID: ENST00000433235
  CDS Start-End: 216-889
taatatccttgaagaagagagaaccattgtttcaagaggaggatgaagatgcaaatagtcagagcacagtgtttgcccaagtttccttaataataggagtcacctggcttgcttagtgaccatcagacgagaccagacctctcacttggatattctgattcagtaggtgtgagttggagccaggaatctctacaaactcattccaggctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagattggaagagtaggaagattaggtcaaaatggaacagcgattactttcatcaataataattcaaaaagactcttctgggatattgcaaaacgagtaaagcccacaggatccattcttccccctcagttattaaattccccataccttca

SEQ ID NO: 125509 - DNA, 580 bp, Homo sapiens
  Payload ID: 4605
  Gene Symbol: DDX59
  Gene Name: DEAD (Asp-Glu-Ala-Asp) box polypeptide 59
  ENST ID: ENST00000452560
  CDS Start-End: 1-283
tcagaaaatcacagggctgaaaagcatatctatacattcagagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagtctactcaccacaatcaatatgaagtttactccataaacagaggtatggtacaagaggtaacgtgtcatccaaggtgactttcctggcagccaccagtaaactgactccggacagataggactcttttgttgccgccaaggcatacttacaatgacctcagaggctctagggccacagtgtgaaaaccaaccaatggataattaagtaaacacagttctcttgttctactgttagtgtgagaacctattttatattttataatgtgttgcacgtgtgatgatataggacaaaattacaaataaagcataagacgagtgtttatttttgtaatgtttacaaatagtaacttacaaataaattttagctttgaaaaa

SEQ ID NO: 125510 - DNA, 6071 bp, Homo sapiens
  Payload ID: 4606
  Gene Symbol: DDX60
  Gene Name: DEAD (Asp-Glu-Ala-Asp) box polypeptide 60
  Uniprot ID: Q8IY21
  ENST ID: ENST00000393743
  CDS Start-End: 293-5431
aggaaaccgaaactcccgccggatgcataaaagactggctgcggtggctcagagcgccgagtcctaggccaggtctggggtaacctggaacttccacctgggctctgcgctaggtctctgtttcactccctccccgcggggcgcgcagctcgcgggtctttggacaccaccggtcctgagtccgcggactgccattttcattaagaactgccacttagaggtaccaaaataaagggtatttgctacctttaatacttgccagttcaggttggaggcacaggcagcagcaagaatggaaagaaatgttcttacaacattttcacaggaaatgtcccagttaattttgaatgaaatgccaaaagctgaatattccagtttattcaatgattttgttgaatctgaattttttttgattgatggggattcattacttatcacatgtatctgtgagatatcatttaagcctgggcagaacctccatttcttctatctggttgaacgctatcttgtggatcttattagcaaaggaggacaattcaccatagttttcttcaaggatgccgagtatgcgtatttcaacttccctgaacttctttctttgagaactgctttaattcttcatcttcagaagaataccaccattgatgttcgaacaacattttcgagatgcttatcaaaagagtggggaagtttcttggaagagagttacccatatttcctgatagttgcagacgaaggcctgaacgatctacaaacacagcttttcaactttttaatcattcattcttgggcaaggaaggtcaacgttgtactttcctcagggcaagaatctgatgttctttgcctttatgcataccttcttccaagcatgtacagacaccagattttttcctggaagaataagcagaacattaaagatgcttatacaaccctgcttaaccagttggaaagatttaagctttcagcattagcacctctttttggaagtttaaaatggaataatattacggaagaggcacacaagactgtatctctgcttacacaagtctggccagaaggatctgacattcggcgtgtcttttgtgttacttcatgctcattatctttgagaatgtaccatcgctttttaggaaacagagagccctcctctggtcaggaaactgagatccaacaggtgaacagtaattgcttaaccctgcaggagatggaagatttgtgtaaactgcattgtctcactgtggtttttctactccatctgcctctttctcaaagagcttgtgctagagtcatcacttcccattgggctgaggacatgaagcctttattacaaatgaaaaagtggtgtgaatatttcatcttaagaaatatacatacttttgaattttggaatctgaatttaattcacctttctgacttaaatgatgagcttttgttgaagaatattgctttttactatgaaaatgaaaatgtaaaaggcctacatttgaatttgggagataccattatgaaagattatgaatatctctggaataccgtatcaaagttggtcagagactttgaggttggacagccatttcctctgagaacaacaaaagtttgttttcttgaaaagaaaccatcaccaatcaaagacagctccaatgaaatggtgcccaatttgggttttattccaacgtcatcttttgtggttgataaatttgctggagatattttgaaagatttgccttttctaaagagtgatgatcctattgttacttcactggttaaacaaaaggaatttgatgaacttgtgcactggcattctcataaacccctgagtgatgattatgacaggtccaggtgtcagtttgatgaaaaatctagagaccctcgtgttcttagatctgtgcaaaagtatcatgttttccaacggttttatgggaattcattagaaacagtctcttcgaaaatcatcgtgactcaaactattaagtcaaagaaggattttagtgggcccaagagcaaaaaggcacacgagaccaaggctgaaataattgctagagagaataagaaaaggttatttgccagggaagaacaaaaggaagagcaaaagtggaatgctttgtcattttctattgaagagcaattgaaagaaaatttacactctggaataaagagcctggaagattttttgaaatcctgtaaaagtagctgtgtgaaacttcaggttgaaatggtggggttaactgcttgcttgaaagcctggaaagaacattgccgaagtgaagaaggtaaaaccacgaaagatttaagtatagctgttcaggtgatgaaaaggatccactccttgatggaaaaatactcagaacttttacaagaagatgatcggcaactcatagccagatgccttaagtatttaggatttgatgagttggcaagttctttacatccagcccaggatgcagaaaatgatgtaaaagtgaagaaaaggaataaatattcagttggcattgggccagctcggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgccttaaactgtcaggtacttattacagtgcctgcctgctttgaaattctgctgcttgctcctcatcgccaaaactgggtgaaaaagatcagatatgttatatttgatgaggttcattgtcttggtggagaaattggagcagaaatctgggaacatctccttgtcatgatccgatgtccctttttggctctttcagctaccataagtaatcctgaacatctcaccgagtggctacaatcggtaaaatggtactggaaacaagaagacaaaataattgaaaataataccgcttctaaaagacatgtgggtcgtcaggccggctttcccaaagactacttgcaagtaaaacaatcgtataaagttagacttgtgctctatggagagaggtataatgatctagagaagcatgtatgttcaataaaacatggtgacattcattttgatcattttcacccatgtgctgcactaacaacagatcatattgaaaggtatggattccctcctgatcttaccctttcacctcgagaaagcatccagctgtatgatgccatgtttcaaatttggaaaagttggcctcgggcccaggaactgtgcccagaaaacttcattcattttaacaataaattagtcattaaaaagatggatgctaggaaatatgaagagagtctaaaggcagaattaacaagttggattaaaaatggcaacgtagagcaggccagaatggtacttcagaatcttagtcctgaagcagatttgagtccagaaaacatgatcaccatgtttccacttctagttgaaaaactaaggaaaatggagaagttacctgcactattttttttattcaagttaggagctgtagaaaacgcagctgaaagtgtgagcactttcctaaagaaaaagcaggagacaaaaaggcctcccaaagctgataaagaagcccatgtcatggctaacaaacttcgaaaagttaaaaaatccatagagaaacaaaagatcatagatgaaaagagccagaaaaaaaccagaaatgtggatcaaagcctaatacatgaagctgaacatgataatctagtgaagtgtctagagaagaacctggaaatcccacaggactgcacatatgctgatcaaaaagcagtggacactgagactttgcagaaggtatttggtcgagtaaaatttgaaagaaaaggtgaagaattgaaagccttggcagaaaggggtattggatatcatcacagtgctatgagtttcaaagaaaaacaattagttgaaatcctctttagaaaaggatatcttagggtggtgacagctactggaacacttgctttaggtgtcaacatgccttgtaaatctgtggtttttgctcaaaactcagtctatctggatgcgttgaattatagacagatgtctggccgtgctggaagaagaggtcaagacctgatgggagatgtatatttctttgatattccattccccaaaataggaaaactcataaaatccaatgttcctgagctgagaggacacttccctctcagcataaccctggtcctgcgactcatgctgctggcttccaagggagatgacccagaggatgccaaggcaaaggtgctatcagtgctaaagcattcattgctgtccttcaagcaacccagagtcatggacatgttaaaactttacttcctgttttctttgcagttcctggtgaaagagggctatttagatcaagaaggtaatcctatggggtttgctggacttgtatcacatttgcattatcatgaaccttctaatcttgtttttgtcagttttcttgtaaatggactcttccatgatctctgtcagccaaccaggaaaggctcaaaacatttttctcaagacgttatggaaaagctagtattagtattggcacatctctttggaagaagatattttccaccaaagttccaagatgcacacttcgagttttatcaatcaaaggtgttccttgatgatctccctgaggattttagtgatgctttagatgaatataacatgaaaattatggaggactttaccactttcctacgaattgtttccaaactggctgatatgaatcaggaatatcaactcccattgtcaaaaatcaaattcacaggtaaagaatgtgaagactctcaactcgtatctcatttgatgagctgcaaggaaggaagagtagcaatttcaccatttgtttgtctgtctgggaactttgatgatgatttgcttcgactagaaactccaaaccatgttactctaggcacaatcggtgtcaatcgctctcaggctccagtgctgttgtcacagaaatttgataaccgaggaaggaaaatgtcgcttaatgcctatgcactggatttctacaaacatggttccttgataggattagtccaggataacaggatgaatgaaggagatgcttattatttgttgaaggattttgcactcaccattaaatctatcagtgtttccttgcgtgagctatgtgaaaatgaagacgacaacgttgtcttagcctttgaacaactgagtacaactttttgggaaaagttaaacaaagtctaaaaacaaagtctatgcaaaccacttaaaaataattccatagtagtttttcaggtcacgtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaagccaaagtaaatataatattatcagtaactttatccccagtgtcagtatttataaaatgtttattaaggctagaaaaaatgaatacaatatcctgaaggtgaaatatattctcttcaattagcataaatatgatttacataagttagctatacagctattgagatagtactttctagtaaacttaaactactttttaaacatacattttgtgatgatttaacaaaaatatagagaatgatttgctttattgtaattgtatataagtgactggaaaagcacaaagaaataaagtgggttcgatctgtttac

SEQ ID NO: 125511 - DNA, 618 bp, Homo sapiens
  Payload ID: 4606
  Gene Symbol: DDX60
  Gene Name: DEAD (Asp-Glu-Ala-Asp) box polypeptide 60
  ENST ID: ENST00000511317
  CDS Start-End: 1-575
atcaatcaaaggtgttccttgatgatctccctgaggattttagtgatgctttagatgaatataacatgaaaattatggaggactttaccactttcctacgaattgtttccaaactggctgatatgaatcaggaatatcaactcccattgtcaaaaatcaaattcacaggtaaagaatgtgaagactctcaactcgtatctcatttgatgagctgcaaggaaggaagagtagcaatttcaccatttgtttgtctgtctgggaactttgatgatgatttgcttcgactagaaactccaaaccatgttactctaggcacaatcggtgtcaatcgctctcaggctccagtgctgttgtcacagaaatttgataaccgaggaaggaaaatgtcgcttaatgcctatgcactggatttctacaaacatggttccttgataggattagtccaggataacaggatgaatgaaggagatgcttattatttgttgaaggattttgcactcaccattaaatctatcaggtgtgttatatatttaaatattgattttagattttttaataatttatttataatttgaaaaatgttgagctgttactataagccaggtacatgaaggtgcc

SEQ ID NO: 125512 - DNA, 534 bp, Homo sapiens
  Payload ID: 4606
  Gene Symbol: DDX60
  Gene Name: DEAD (Asp-Glu-Ala-Asp) box polypeptide 60
  ENST ID: ENST00000514995
  CDS Start-End: 176-534
aaaccgaaactcccgccggatgcataaaagactggctgcggtggctcagagcgccgagtcctaggccaggactgccattttcattaagaactgccacttagaggtaccaaaataaagggtatttgctacctttaatacttgccagttcaggttggaggcacaggcagcagcaagaatggaaagaaatgttcttacaacattttcacaggaaatgtcccagttaattttgaatgaaatgccaaaagctgaatattccagtttattcaatgattttgttgaatctgaattttttttgattgatggggattcattacttatcacatgtatctgtgagatatcatttaagcctgggcagaacctccatttcttctatctggttgaacgctatcttgtggatcttattagcaaaggaggacaattcaccatagttttcttcaaggatgccgagtatgcgtatttcaacttccctgaacttctttctttgagaactgctttaattcttcatcttcagaagaataccaccattgatgttcg

SEQ ID NO: 125513 - DNA, 542 bp, Homo sapiens
  Payload ID: 4606
  Gene Symbol: DDX60
  Gene Name: DEAD (Asp-Glu-Ala-Asp) box polypeptide 60
  ENST ID: ENST00000513997
  CDS Start-End: 1-314
tccgatgtccctttttggctctttcagctaccataagtaatcctgaacatctcaccgagtggctacaatcggtaaaatggtactggaaacaagaagacaaaataattgaaaataataccgcttctaaaagacatgtgggtcgtcaggccggctttcccaaagactacttgcaagtaaaacaatcgtataaagttagacttgtgctctatggagagaggtataatgatctagagaagcatgtatgttcaataaaacatggtgacattcattttgatcattttcacccatgtgctgcactaacaacagatcattagctattaatggagtaactggaaagcaatagaactgctacagtgtgctgtgaccccagatgacttctgcaaaggtcatgctgttgtatgagtcttcttaagatgtctagacttttgtggcaggaatgcagaatgaacataaagacttagattgaaaggtatggattccctcctgatcttaccctttcacctcgagaaagcatccagctgtatgatgccatgtttcaaatt

SEQ ID NO: 125514 - DNA, 6754 bp, Homo sapiens
  Payload ID: 4607
  Gene Symbol: DDX60L
  Gene Name: DEAD (Asp-Glu-Ala-Asp) box polypeptide 60-like
  Uniprot ID: Q5H9U9
  ENST ID: ENST00000260184
  CDS Start-End: 222-5342
agagcgcccagtccgacgccaggctctgcgctcggtctcctctgctccacctcctccccgcggggcgtgcagctccgaagctctttggacctagcaggttcggcggccgggaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctgaacttctttcattgaggaccgctttaattctccaccttcaacacaatactaacattgatgtgcaaacggagttttctggatgcttatcacaagattggaagttattcttggaacagcattacccgtattttctgatagtttcagaggaaggcctgagtgatttacaaacgtacctttttaacttcctaatcatacattcctggggaatgaaagtcaatgttgtgctttcatcagggcatgaatctgatactctcagattttatgcatatactatggaaagcacagacagaaaccaaactttttccaaggagaatgaaacagtgattcagagtgcatataaaagcctcatacaacacttggaagaaataagggttttagtattagcaactcattttgaacatttgaaatggaatgatatgatggaagaggcgtatcagactctatttctgcttcagcacctatggtcagaaggatcggacatccagcgtgttctctgtgtcacttcatgttcactatccttgagaatgtaccatcgtgtcttagtgcacagtaattgcctatccctgcaggaggtggaagatttctgcagactgcgttgcctctgtgtggcttttcaactccacttacccctttctcagagagcttgttctcgagtcatcacatgctcttggattaggaacagtgattctttcttaaaaatgaacaagtggtgtgaatatttcattttaagcaacttaaacgtttttggatgctggaatctgaatttaaatcatgtttctgacttgtatgatgagcaattgttaaagaatatagccttctactatgaatttgaaagtactcaagaaccacatttgaatttgggagattccattaggagggattatgaagacctgtggaatgttgtgtcacacctggttaaagaatttaacgttggaaagtcttttcctctgagaacaacaagaagacattttcttagacaagagaaatcggtcattcaagaaatctccttggaaaagatgcctagtgtgggctttattccaatgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaaataagaagaaatattcgattgacattggaccagctcggtttcaactgcaatacatgggccattacttgataagagatgaaagaaaagatcgggatcccagggtccaggattttattcccaacgcatggcagcaggaactcctggatgtggtagataagaatgagtcagcagtgattgttgccccaacgtcctcaggcaaaacctatgcttcctactactgcatggagaaagtgctgagggagagcgatgtcggggtggttgtgtacgttgcacccgcaaagtcccttgttggtcaagtggctgcaactgttgagaatcgttttactaaaacgttgcctgccggcagaactctatgcggtgcttttacaagagattattgtcacaatgtactaaactgtcaggtacttattacagtgccggaatgttttgaaatcctgttgcttgctcctcatcgccaaaaatgggtggaaaggatcagatatgttatatttgatgaggtccattatcttggcagagaagttggagcaaaattttgggagctcctccttgtcattattcgatgtccctttttggttctttcagctaccataaataacccaaatcttctcaccaagtggctgcaatcagtaaaacagtactggaaacaggcagacaagattatggaagagaaatgtatttctgaaaaacaggctgacaaatgtctcaactttctccaagaccattcatataaaaatcaatcatatgaagttagacttgtgctctgtggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggatcactaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggagagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctgttgtttttgcccaagactcagtctatctggatgctttaaattacagacagatgtctggtcgtgctggaagaagaggtcaagacctgcttggaaatgtgtatttctttgatatcccattgcccaaaataaaaagactccttgcatccagtgttcctgagctgagaggacagttccctctcagcataaccctggtcctgcgactcatgctgctggcttccaagggagatgacccagaggatgccaaggcaaaggtgttgtcagtgctaaagcattcattgctgtcttttaagagacgaagagccatggagactttgaaactttactttttgttttccttgcagctccttatcaaagaggactatttaaataaaaagggtaatccaaagaaatttgcaggacttgcatcatatttgcatggtcatgaaccttcaaatcttgtttttgtaaattttctcaagagaggccttttccataatctctgtaagccagcctggaaaggctcacaacaattttcccaagatgtgatggaaaagctcgtgttagtattggcaaatttgtttggaagaaaatatattccagcaaaattccaaaatgctaatttaagtttttctcagtcaaaggtgatccttgccgaactcccggaggattttaaagctgctttatatgagtataacctggcagtaatgaaggattttgcctccttcctgctgattgcttccaagtcggtgaacatgaaaaaagagcatcaactccctttgtcaagaatcaaattcacaggtaaagaatgtgaagactcccaactcgtgtctcacttgatgagctgcaagaaaggaagagtagccatttcaccatttgtttgtctttcggggaacacagataatgatttgcttcgaccagagactatcaaccaggtcatcctgcgcacagtcggtgttagtggcactcaggctcctctgctgtggccatggaaattagataaccgaggaaggagaatgccactaaatgcatatgtgctcaatttctataaacacaactgcttgacaagattagaccaaaaaaatgggatgcgtatgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagatatcagctctgctattttctaactgaatgactttaagttatgtaatatatctgagctttaacttcatttttggcaaaaccggagtaaaaatgaatacctctagttgttttgaggattaaatgagataatgtaagaaaagtgattgggattgggtggtgacttaatgaacggtagtggtttttttagtagttaatgtatagcaaaattagtttcacattgtcaagttttcaatacatccccaagttaattgaattttaaattaatgatcaataaatcacaaaggacccaaatcaattctgaacaacaatttagttatgtaagaagacttctgagattacaagaaactcactgctgtggactggatgtttgtgccctcccctccaaaatttttatattgaaattctaaccctcaatgtgatggtattaggagatgataggtcatgagggtggagctccttggatgtaattagtgcctttaacagagagacaagagagcttgttctccaatctctgctcactaccactggatgatacaatgggaagatggccatctgcagaccaagaagcaagccctcaacagaactgaatctacttacaccatgatcttgaactttccagcctccaggattgtgagaaatacatgtttgttgtttagccatctagtctgtggttttctgttgaagcagtctgaattgactaaaacagtcacttggagtagttataaaccactttcctgttgaaagcagaacatgctgattcaactgttttgttcaatagcaatgatagattttgtttaagtcccctacactttcttatttctaaatgatcaagagtacacttcctggcagtgattaaggagtgtgtatctaacagaaaaaatatatataccctgtgaacccgaatatggaattcagattgtttctgccctcagtatcatacttaaaaaacaagcatacaaacaaacataagggaacaaacagcaaccataacaaaaacaaacctttaaaggtgcgtttttgctgtgataaatgaatacggtactctgaaggagaaaaaagtttctcaaatgagcttaaactgcaagtgatttaaaaattagagaatataattcttaaagctattgaaagtttcaaccagaaaacctcaagtgaattttgtatgtaaatgaaatcttgaatgtaagttctgtgattctttaagcaaacaattagctgaaaacttggtattgttgtagtttatgtagtaagtgacttggcacccatcagaaaataaagggcattaaattga

SEQ ID NO: 125515 - DNA, 2605 bp, Homo sapiens
  Payload ID: 4607
  Gene Symbol: DDX60L
  Gene Name: DEAD (Asp-Glu-Ala-Asp) box polypeptide 60-like
  ENST ID: ENST00000505863
  CDS Start-End: 1-2605
agaatgtaccatcgtgtcttagtgcacagtaattgcctatccctgcaggaggtggaagatttctgcagactgcgttgcctctgtgtggcttttcaactccacttacccctttctcagagagcttgttctcgagtcatcacatgctcttggattaggaacagtgattctttcttaaaaatgaacaagtggtgtgaatatttcattttaagcaacttaaacgtttttggatgctggaatctgaatttaaatcatgtttctgacttgtatgatgagcaattgttaaagaatatagccttctactatgaatttgaaagtactcaagaaccacatttgaatttgggagattccattaggagggattatgaagacctgtggaatgttgtgtcacacctggttaaagaatttaacgttggaaagtcttttcctctgagaacaacaagaagacattttcttagacaagagaaatcggtcattcaagaaatctccttggaaaagatgcctagtgtgggctttattccaatgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaaataagaagaaatattcgattgacattggaccagctcggtttcaactgcaatacatgggccattacttgataagagatgaaagaaaagatcgggatcccagggtccaggattttattcccaacgcatggcagcaggaactcctggatgtggtagataagaatgagtcagcagtgattgttgccccaacgtcctcaggcaaaacctatgcttcctactactgcatggagaaagtgctgagggagagcgatgtcggggtggttgtgtacgttgcacccgcaaagtcccttgttggtcaagtggctgcaactgttgagaatcgttttactaaaacgttgcctgccggcagaactctatgcggtgcttttacaagagattattgtcacaatgtactaaactgtcaggtccattatcttggcagagaagttggagcaaaattttgggagctcctccttgtcattattcgatgtccctttttggttctttcagctaccataaataacccaaatcttctcaccaagtggctgcaatcagtaaaacagtactggaaacaggcagacaagattatggaagagaaatgtatttctgaaaaacaggctgacaaatgtctcaactttctccaagaccattcatataaaaatcaatcatatgaagttagacttgtgctctgtggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggatcactaaaaaaaacccaaagaaggctg

SEQ ID NO: 125516 - DNA, 4568 bp, Homo sapiens
  Payload ID: 4607
  Gene Symbol: DDX60L
  Gene Name: DEAD (Asp-Glu-Ala-Asp) box polypeptide 60-like
  Uniprot ID: Q5H9U9
  ENST ID: ENST00000505890
  CDS Start-End: 222-4148
agagcgcccagtccgacgccaggctctgcgctcggtctcctctgctccacctcctccccgcggggcgtgcagctccgaagctctttggacctagcaggttcggcggccgggaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctgaacttctttcattgaggaccgctttaattctccaccttcaacacaatactaacattgatgtgcaaacggagttttctggatgcttatcacaagattggaagttattcttggaacagcattacccgtattttctgatagtttcagaggaaggcctgagtgatttacaaacgtacctttttaacttcctaatcatacattcctggggaatgaaagtcaatgttgtgctttcatcagggcatgaatctgatactctcagattttatgcatatactatggaaagcacagacagaaaccaaactttttccaaggagaatgaaacagtgattcagagtgcatataaaagcctcatacaacacttggaagaaataagggttttagtattagcaactcattttgaacatttgaaatggaatgatatgatggaagaggcgtatcagactctatttctgcttcagcacctatggtcagaaggatcggacatccagcgtgttctctgtgtcacttcatgttcactatccttgagaatgtaccatcgtgtcttagtgcacagtaattgcctatccctgcaggaggtggaagatttctgcagactgcgttgcctctgtgtggcttttcaactccacttacccctttctcagagagcttgttctcgagtcatcacatgctcttggattaggaacagtgattctttcttaaaaatgaacaagtggtgtgaatatttcattttaagcaacttaaacgtttttggatgctggaatctgaatttaaatcatgtttctgacttgtatgatgagcaattgttaaagaatatagccttctactatgaatttgaaagtactcaagaaccacatttgaatttgggagattccattaggagggattatgaagacctgtggaatgttgtgtcacacctggttaaagaatttaacgttggaaagtcttttcctctgagaacaacaagaagacattttcttagacaagagaaatcggtcattcaagaaatctccttggaaaagatgcctagtgtgggctttattccaatgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaaataagaagaaatattcgattgacattggaccagctcggtttcaactgcaatacatgggccattacttgataagagatgaaagaaaagatcgggatcccagggtccaggattttattcccaacgcatggcagcaggaactcctggatgtggtagataagaatgagtcagcagtgattgttgccccaacgtcctcaggcaaaacctatgcttcctactactgcatggagaaagtgctgagggagagcgatgtcggggtggttgtgtacgttgcacccgcaaagtcccttgttggtcaagtggctgcaactgttgagaatcgttttactaaaacgttgcctgccggcagaactctatgcggtgcttttacaagagattattgtcacaatgtactaaactgtcaggtacttattacagtgccggaatgttttgaaatcctgttgcttgctcctcatcgccaaaaatgggtggaaaggatcagatatgttatatttgatgaggtccattatcttggcagagaagttggagcaaaattttgggagctcctccttgtcattattcgatgtccctttttggttctttcagctaccataaataacccaaatcttctcaccaagtggctgcaatcagtaaaacagtactggaaacaggcagacaagattatggaagagaaatgtatttctgaaaaacaggctgacaaatgtctcaactttctccaagaccattcatataaaaatcaatcatatgaagttagacttgtgctctgtggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggattagcactaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggagagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctgttgtttttgcccaagactcagtctatctggatgctttaaattacagacagatcatgtgaactctcctagactggaatatgaagactgtgattttacagagaaaaggagtttatctccatttcatgaccttttaggatgttgctgtttcaactttaaaagccatattttccttttctcaagtatagctatagaccatatcaccttttaccatgttctgttatgaaaaacaggaagtccctgagctggaatttttcagtctttctctttttcatgtagagagcaaagtttctcttaagggacttttgtttccttcagaattatggtctccttttttctcttccttgccaaaatcactagtttggaagaaatccaacatcatttatttactatggaccacaatgagagtggaactactttgttatcctgccctgatgacttagcattatctcctaggacagaataaaatatactttctctgt

SEQ ID NO: 125517 - DNA, 6781 bp, Homo sapiens
  Payload ID: 4607
  Gene Symbol: DDX60L
  Gene Name: DEAD (Asp-Glu-Ala-Asp) box polypeptide 60-like
  Uniprot ID: Q5H9U9
  ENST ID: ENST00000511577
  CDS Start-End: 249-5369
actcaggcgctggctgctgtgtggctcagagcgcccagtccgacgccaggctctgcgctcggtctcctctgctccacctcctccccgcggggcgtgcagctccgaagctctttggacctagcaggttcggcggccgggaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctgaacttctttcattgaggaccgctttaattctccaccttcaacacaatactaacattgatgtgcaaacggagttttctggatgcttatcacaagattggaagttattcttggaacagcattacccgtattttctgatagtttcagaggaaggcctgagtgatttacaaacgtacctttttaacttcctaatcatacattcctggggaatgaaagtcaatgttgtgctttcatcagggcatgaatctgatactctcagattttatgcatatactatggaaagcacagacagaaaccaaactttttccaaggagaatgaaacagtgattcagagtgcatataaaagcctcatacaacacttggaagaaataagggttttagtattagcaactcattttgaacatttgaaatggaatgatatgatggaagaggcgtatcagactctatttctgcttcagcacctatggtcagaaggatcggacatccagcgtgttctctgtgtcacttcatgttcactatccttgagaatgtaccatcgtgtcttagtgcacagtaattgcctatccctgcaggaggtggaagatttctgcagactgcgttgcctctgtgtggcttttcaactccacttacccctttctcagagagcttgttctcgagtcatcacatgctcttggattaggaacagtgattctttcttaaaaatgaacaagtggtgtgaatatttcattttaagcaacttaaacgtttttggatgctggaatctgaatttaaatcatgtttctgacttgtatgatgagcaattgttaaagaatatagccttctactatgaatttgaaagtactcaagaaccacatttgaatttgggagattccattaggagggattatgaagacctgtggaatgttgtgtcacacctggttaaagaatttaacgttggaaagtcttttcctctgagaacaacaagaagacattttcttagacaagagaaatcggtcattcaagaaatctccttggaaaagatgcctagtgtgggctttattccaatgacatctgctgtaattgatgagtttgttggagatatgatgaaggatttgcctattctaaagagtgatgatccggttgttccttcactgtttaaacaaaagacatctgatgaacttttgcactggcatgctcaaagactccttagtgacgactatgacaggatcaaatgtcatgttgatgaacaatctagagatcctcatgttcttgatttcctgaaaaagattcaggattatcagcaattttatgggaaatcgttagaatcaatctctacgaaagtcattgtgactcaaactactcggccaaaggaggattccagtggtgccagtggtgaaatattacagaataccaaaccccaccaaattaccaaaaagagtaagaaaaagtcatttctcaaagaagatcagaacaaagctcagcaaaacgatgatctgctgttttctattgaagaggagatgaagaacaatttacattctggaataaggaaattggaagattatttgacatcatgtgcaagtaattcagtgaaatttggagttgaaatgttaggattaattgcctgctttaaagcatggaaaaaacattgccgaggtgaaggcaaaatttcgaaagatttaagtatagctgttcaaatgatgaaaaggattcattcactcctggagagatacccagaaattttggaagcagaacatcatcaatatatagctaaatgccttaaatatttaggctttaatgatctggcaaactctttggatccaactctgataggagatgacaaaaataagaagaaatattcgattgacattggaccagctcggtttcaactgcaatacatgggccattacttgataagagatgaaagaaaagatcgggatcccagggtccaggattttattcccaacgcatggcagcaggaactcctggatgtggtagataagaatgagtcagcagtgattgttgccccaacgtcctcaggcaaaacctatgcttcctactactgcatggagaaagtgctgagggagagcgatgtcggggtggttgtgtacgttgcacccgcaaagtcccttgttggtcaagtggctgcaactgttgagaatcgttttactaaaacgttgcctgccggcagaactctatgcggtgcttttacaagagattattgtcacaatgtactaaactgtcaggtacttattacagtgccggaatgttttgaaatcctgttgcttgctcctcatcgccaaaaatgggtggaaaggatcagatatgttatatttgatgaggtccattatcttggcagagaagttggagcaaaattttgggagctcctccttgtcattattcgatgtccctttttggttctttcagctaccataaataacccaaatcttctcaccaagtggctgcaatcagtaaaacagtactggaaacaggcagacaagattatggaagagaaatgtatttctgaaaaacaggctgacaaatgtctcaactttctccaagaccattcatataaaaatcaatcatatgaagttagacttgtgctctgtggagagagatacaatgatttagagaagcatatatgttcagtaaaacatgatgatgtttattttgatcattttcatccctgtgctgcgctaacgacagatattattgaaaagtatggattcccacctgatcttaccctcacccctcaagaaagcatccagctttatgataccatggctcaagtctgggaaacttggcccagggctcaggaattgtgtccagaggaattcattctttttaagaataagatagtcattaagaagttggatgctagaaaatatgaagaaaacttaaaggcagaattgacaaattggattaaaaatggccaagtgaagaaggtcaaaagagtactgaagaaccttagtccggattcattgtctagttcaaaagatatggtgaaaatgtttcctcttcttgttgaaaagttaagacaaatggataagttgcctgcaatattttttttgtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggatcactaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggagagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctgttgtttttgcccaagactcagtctatctggatgctttaaattacagacagatgtctggtcgtgctggaagaagaggtcaagacctgcttggaaatgtgtatttctttgatatcccattgcccaaaataaaaagactccttgcatccagtgttcctgagctgagaggacagttccctctcagcataaccctggtcctgcgactcatgctgctggcttccaagggagatgacccagaggatgccaaggcaaaggtgttgtcagtgctaaagcattcattgctgtcttttaagagacgaagagccatggagactttgaaactttactttttgttttccttgcagctccttatcaaagaggactatttaaataaaaagggtaatccaaagaaatttgcaggacttgcatcatatttgcatggtcatgaaccttcaaatcttgtttttgtaaattttctcaagagaggccttttccataatctctgtaagccagcctggaaaggctcacaacaattttcccaagatgtgatggaaaagctcgtgttagtattggcaaatttgtttggaagaaaatatattccagcaaaattccaaaatgctaatttaagtttttctcagtcaaaggtgatccttgccgaactcccggaggattttaaagctgctttatatgagtataacctggcagtaatgaaggattttgcctccttcctgctgattgcttccaagtcggtgaacatgaaaaaagagcatcaactccctttgtcaagaatcaaattcacaggtaaagaatgtgaagactcccaactcgtgtctcacttgatgagctgcaagaaaggaagagtagccatttcaccatttgtttgtctttcggggaacacagataatgatttgcttcgaccagagactatcaaccaggtcatcctgcgcacagtcggtgttagtggcactcaggctcctctgctgtggccatggaaattagataaccgaggaaggagaatgccactaaatgcatatgtgctcaatttctataaacacaactgcttgacaagattagaccaaaaaaatgggatgcgtatgggacagcttttaaagtgtttgaaagattttgcattcaacattcaggctatcagtgactccttgagtgaactatgtgaaaataagcgtgacaatgtagtcctggcatttaaacaattgagtcaaaccttttatgagaaacttcaagaaatgcaaattcaaatgagtcaaaatcatttagaataacaccatggaaaactttcaagtctgattatgtggtatttatccctttgcaaggagagatataattaagcttacacaatgaaatggaaaaaatgtttgtcttggagtcaaacagaattaaactcagatatcagctctgctattttctaactgaatgactttaagttatgtaatatatctgagctttaacttcatttttggcaaaaccggagtaaaaatgaatacctctagttgttttgaggattaaatgagataatgtaagaaaagtgattgggattgggtggtgacttaatgaacggtagtggtttttttagtagttaatgtatagcaaaattagtttcacattgtcaagttttcaatacatccccaagttaattgaattttaaattaatgatcaataaatcacaaaggacccaaatcaattctgaacaacaatttagttatgtaagaagacttctgagattacaagaaactcactgctgtggactggatgtttgtgccctcccctccaaaatttttatattgaaattctaaccctcaatgtgatggtattaggagatgataggtcatgagggtggagctccttggatgtaattagtgcctttaacagagagacaagagagcttgttctccaatctctgctcactaccactggatgatacaatgggaagatggccatctgcagaccaagaagcaagccctcaacagaactgaatctacttacaccatgatcttgaactttccagcctccaggattgtgagaaatacatgtttgttgtttagccatctagtctgtggttttctgttgaagcagtctgaattgactaaaacagtcacttggagtagttataaaccactttcctgttgaaagcagaacatgctgattcaactgttttgttcaatagcaatgatagattttgtttaagtcccctacactttcttatttctaaatgatcaagagtacacttcctggcagtgattaaggagtgtgtatctaacagaaaaaatatatataccctgtgaacccgaatatggaattcagattgtttctgccctcagtatcatacttaaaaaacaagcatacaaacaaacataagggaacaaacagcaaccataacaaaaacaaacctttaaaggtgcgtttttgctgtgataaatgaatacggtactctgaaggagaaaaaagtttctcaaatgagcttaaactgcaagtgatttaaaaattagagaatataattcttaaagctattgaaagtttcaaccagaaaacctcaagtgaattttgtatgtaaatgaaatcttgaatgtaagttctgtgattctttaagcaaacaattagctgaaaacttggtattgttgtagtttatgtagtaagtgacttggcacccatcagaaaataaagggcattaaattga

SEQ ID NO: 125518 - DNA, 813 bp, Homo sapiens
  Payload ID: 4607
  Gene Symbol: DDX60L
  Gene Name: DEAD (Asp-Glu-Ala-Asp) box polypeptide 60-like
  ENST ID: ENST00000514580
  CDS Start-End: 1-586
gtttaagaatgatgatgtgggaaaaagagctggaagtgtgtgcacttttctggagaagacagagacaaaaagccatccccacactgaatgtcatagttatgtctttgcaatagatgaagtacttgaaaaagtgaggaagacacagaaaaggatcactaaaaaaaacccaaagaaggctgaaaaactggaaagaaaaaaagtgtatagagctgaatatattaatttcctggagaatctgaagattctggaaatttctgaggactgcacgtatgctgatgtcaaagccctacacactgaaattaccaggaataaagactcaactttggagagggtattaccgcgagtgcgatttacaagacacggcaaagaactgaaggctttagcacaaagggggattggatatcatcacagcagcatgtattttaaagaaaaagagtttgttgagatactctttgtaaaagggcttattagggtagtgacagctactgaaacacttgccttagggatccacatgccatgcaaatctgttgtttttgcccaagactcagtctatctggatgctttaaattacagacagatcatgtgaactctcctagactggaatatgaagactgtgattttacagagaaaaggagtttatctccatttcatgaccttttaggatgttgctgtttcaactttaaaagccatattttccttttctcaagtatagctatagaccatatcaccttttaccatgttctgttatgaaaaacaggaagtccctgagctggaatttttcagtctttctctttttcatgtagagagcaaagt

SEQ ID NO: 125519 - DNA, 588 bp, Homo sapiens
  Payload ID: 4607
  Gene Symbol: DDX60L
  Gene Name: DEAD (Asp-Glu-Ala-Asp) box polypeptide 60-like
  ENST ID: ENST00000505696
  CDS Start-End: 215-588
aacatccagatggaccgggcggggaggtggcctggtggcttcgtgcgcgccgggcgagggaagctggggcgcccactgggctcgggcggcagcttcgcggagagaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctgaacttctttcattgaggaccgctttaattctccaccttcaacacaatactaacattgatgtgcaaacggagttttctgg

SEQ ID NO: 125520 - DNA, 632 bp, Homo sapiens
  Payload ID: 4607
  Gene Symbol: DDX60L
  Gene Name: DEAD (Asp-Glu-Ala-Asp) box polypeptide 60-like
  ENST ID: ENST00000514748
  CDS Start-End: 337-632
gtccgacgccaggctctgcgctcggtctcctctgctccacctcctccccgcggggcgtgcagctccgaagctctttggacctagcaggttcggcggccgggtttgctaaagctgccataacaaaatattatagagtggtggcttaaacaacagaaatttatttctcactattctggaggctgtgaagtacaagatcaagattctggctgattgagtttctggtgagaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagtaacggaggacaattcaccatagttttctttaaggatgctgaatatgcatattttgattttcctga

SEQ ID NO: 125521 - DNA, 428 bp, Homo sapiens
  Payload ID: 4607
  Gene Symbol: DDX60L
  Gene Name: DEAD (Asp-Glu-Ala-Asp) box polypeptide 60-like
  ENST ID: ENST00000512371
  CDS Start-End: 198-428
gtccgacgccaggctctgcgctcggtctcctctgctccacctcctccccgcggggcgtgcagctccgaagctctttggacctagcagaggtgccattcacatcaaatgtagccattttagaggtgtcaaaataaatcagccatatttaataaattccagctctactcttctaccctgtagcccaagaagcagcaacgatggggtcaaaggatcatgcagtatttttcagggaaatgacacagttaattttgaatgaaatgccaaaagctgggtattccagcatattaaatgattttgtggaatctaatttttttgtgattgatggagattccttgcttgtcacatgcctgggtgtaaaatcattcaagtggggacagaatctccactttttctatctggttgaatgctatcttgtggatcttctgagt

SEQ ID NO: 125522 - DNA, 3717 bp, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENST ID: ENST00000228264
  CDS Start-End: 120-2762
gttgttccggctgcctttcactgaggggacccgccagtttctaactcagtggcgtttgccctgattcccggggcctggctttcagcgtagcaattctgccggcgaagaaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 125523 - DNA, 3724 bp, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENST ID: ENST00000350437
  CDS Start-End: 199-2769
ttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 125524 - DNA, 883 bp, Homo sapiens
  Payload ID: 4608
  Gene Symbol: DDX11
  Gene Name: DEAD/H (Asp-Glu-Ala-Asp/His) box helicase 11
  ENST ID: ENST00000415475
  CDS Start-End: 210-883
gccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctt

SEQ ID NO: 125525 - DNA, 4182 bp, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENST ID: ENST00000435753
  CDS Start-End: 221-1087
ttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagggcgccttctgatgccacctccagccgccatccaccagacgccagcttccccgctgccctgaacttcctccagcgcaccaggccttcctctgtcctgtctgaggatttgctcatgcaacgtgctgtggccaaacaccctgccctcctcccttggcagatgtcttcctctcctttaaggcctggctcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtgttttcggcccctccctggctcttaccaggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaaggtcagtcctacctttttctttctgagagcctccccaccccgagatcacatttctcactgccttctgtctgcccagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 125526 - DNA, 1135 bp, Homo sapiens
  Payload ID: 4608
  Gene Symbol: DDX11
  Gene Name: DEAD/H (Asp-Glu-Ala-Asp/His) box helicase 11
  ENST ID: ENST00000438391
  CDS Start-End: 229-1135
ggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaagaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctgg

SEQ ID NO: 125527 - DNA, 613 bp, Homo sapiens
  Payload ID: 4608
  Gene Symbol: DDX11
  Gene Name: DEAD/H (Asp-Glu-Ala-Asp/His) box helicase 11
  ENST ID: ENST00000543756
  CDS Start-End: 188-424
tggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctgggg

SEQ ID NO: 125528 - DNA, 879 bp, Homo sapiens
  Payload ID: 4608
  Gene Symbol: DDX11
  Gene Name: DEAD/H (Asp-Glu-Ala-Asp/His) box helicase 11
  ENST ID: ENST00000535317
  CDS Start-End: 305-879
tagatttggcccagctgtgttgagcttttcatggattatcttacgtagataagacactgcaacagacttcacaacgggataaagtgaagtagcttcggcttgtgaatgtgcattgcagagacgtgggagaagaaagctgcaaaagtcattataagcaacacccttgatcttaggggtgctggtctgtgagaagagagctctaagccttttgtagaggcattagaaaggtatcggagccacggtgaaatgcaggggagattgggtttaggggctttcctggtctgcattctgctacagccgttaaatgccgctagatggagtgcgtgattctggtatggcctcacgtggacctgctgcgaaggatggagagaacatggtctctgcttcccagaaaaaaggagaaatttggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgc

SEQ ID NO: 125529 - DNA, 3751 bp, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENST ID: ENST00000545668
  CDS Start-End: 81-2993
cagtttctaactcagtggcgtttgccctgattcccggggcctggctttcagcgtagcaattctgccggcgaagaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctcagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 125530 - DNA, 951 bp, Homo sapiens
  Payload ID: 4608
  Gene Symbol: DDX11
  Gene Name: DEAD/H (Asp-Glu-Ala-Asp/His) box helicase 11
  ENST ID: ENST00000539702
  CDS Start-End: 1-518
accaggtggagcaggtgctgctggcatattccaggtgcatccaggtgcgggcgtcatgctgggcttgggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggact

SEQ ID NO: 125531 - DNA, 1193 bp, Homo sapiens
  Payload ID: 4608
  Gene Symbol: DDX11
  Gene Name: DEAD/H (Asp-Glu-Ala-Asp/His) box helicase 11
  ENST ID: ENST00000542244
  CDS Start-End: 113-628
ggtgcgcagaagtgggcattaacagcagccgcgtgtctgggtcttagatttggcccagctgtgttgagcttttcatggattatcttacgtagataagacactgcaacagtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaagctgggctgtgagtggttgaggcgtggatcctaggagtcgacctctctccagccaggcagccaggcctatgtgaatggggcgtggtgtgctttgtctctggcatgtggggagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacggtagccactgggaccatggtgtagccgcaggtggtctggagagagtgaggcaggggtggcagtgactgaagaccattaagtgtctttcatagaaagaatggcagaggagaccccagttccttcctgag

SEQ ID NO: 125532 - DNA, 1561 bp, Homo sapiens
  Payload ID: 4608
  Gene Symbol: DDX11
  Gene Name: DEAD/H (Asp-Glu-Ala-Asp/His) box helicase 11
  ENST ID: ENST00000542129
  CDS Start-End: 237-1151
gttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagaca

SEQ ID NO: 125533 - DNA, 3079 bp, Homo sapiens
  Payload ID: 4608
  Gene Symbol: DDX11
  Gene Name: DEAD/H (Asp-Glu-Ala-Asp/His) box helicase 11
  Uniprot ID: Q96FC9
  ENST ID: ENST00000542838
  CDS Start-End: 252-2972
tgcgcagcggcgggggttgttccggctgcctttcactgaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagatattccaggaacctaagagcgcacaccaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctccccagagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaa

SEQ ID NO: 125534 - DNA, 1210 bp, Homo sapiens
  Payload ID: 4608
  Gene Symbol: DDX11
  Gene Name: DEAD/H (Asp-Glu-Ala-Asp/His) box helicase 11
  ENST ID: ENST00000540935
  CDS Start-End: 101-967
actgaggggacccgccagtttctaactcagtggcgtttgccctgattcccggggcctggctttcagcgtagcaattctgccggcgaagaaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgttgctgtcctctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgc

SEQ ID NO: 125535 - DNA, 545 bp, Homo sapiens
  Payload ID: 4608
  Gene Symbol: DDX11
  Gene Name: DEAD/H (Asp-Glu-Ala-Asp/His) box helicase 11
  ENST ID: ENST00000545115
  CDS Start-End: 1-230
accaggtggagcaggtgctgctggcatattccaggtgcatccaggcctgtggccaggagagaggccaggtgacaggggccctgctcctctctgtggttggaggaaagatgagtgaagggatcaacttctctgacaacctaggccggtctgcagagctgcaggagaagatggcctacttggatcaaaccctcgcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccg

SEQ ID NO: 125536 - DNA, 498 bp, Homo sapiens
  Payload ID: 4608
  Gene Symbol: DDX11
  Gene Name: DEAD/H (Asp-Glu-Ala-Asp/His) box helicase 11
  ENST ID: ENST00000538345
  CDS Start-End: 1-96
cttatttgtggggccctctcttggctccgtgactttgaacagaagaagcgtgacaggggccctgctcctctctgtggttggaggaaagatgagtgaagggatcaacttctctgacaacctaggccggtgtgtggtgatggtgggcatgcccttccccaacatcaggtctgcagagctgcaggagaagatggcctacttggatcaaaccctcagcccccggccaggcacccccagggaaggctctggtggagaacctgtgcatgaaggccgtcaaccagtccataggcagggccatcaggcaccagaaggattttgccagcgtagtgctcctggaccagcgatatgcccggccccctgtcctggccaagctgccggcctggatccgagcccgtgtggaggtcaaagctacctttggccccgccattgctgctgtgcagaagtttcaccgggagaagtcggcctcttcctgatgggcaaccacaccactgcctggcgccg

SEQ ID NO: 125537 - DNA, 3471 bp, Homo sapiens
  Payload ID: 4608
  Gene Symbol: DDX11
  Gene Name: DEAD/H (Asp-Glu-Ala-Asp/His) box helicase 11
  ENST ID: ENST00000539049
  CDS Start-End: 215-1108
gaggggacccgccagtttctaactcagtggcgtttgccctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtccatggctaatgaaacacagaaggttggtgccatccattttccttttcccttcacaccctattccatccaggaagacttcatggcagagctgtaccgggttttggaggctggcaagattgggatatttgagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaaggcggagcaggccaggaggaagcagcgagaagaacgcctgcagcagctgcagcacagggtgcagctcaagtatgcagccaagcgcctgaggcaggaagaagaagaaagagagaatctcctccgcctcagcagggagatgctagagacaggcccggaggctgagcggctggagcagctggagtctggggaggaggagctggtcctcgccgaatacgagagtgatgaggagaaaaaggtggcgagcagagtggatgaggatgaggatgacctggaggaagaacacataactaagatttattactgtagtcggacacactcccagctggcccagtttgtgcatgaggtgaagaagagcccctttggcaaggatgttcggctggtctcccttggctcccggcagaacctttgtgtaaatgaagacgtgaaaagcctaggttctgtgcagcttatcaacgaccgctgtgtggacatgcagagaagcaggcacgaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacgggagccgccttgccatccctgcagcccagctggtggtgctgccctatcagatgctgctgcatgcggccactcggcaggccgcgggcatccggctgcaggaccaggtggtgatcatcgacgaggcgcacaacctgatcgacaccatcacgggcatgcacagcgtggaggtcagcggctcccagctctgccaggcccattcccagctgctgcagtacgtggagcgatacgggaagcgtttgaaggccaagaacctgatgtacctgaagcagatcctgtatttgctggagaaattcgtggctgtgctaggggggaacattaagcaaaatcccaatacacagagtctgtcacagacagggacggagctgaagaccatcaacgactttctcttccagagccagatcgacaacatcaacctgttcaaggtgcagcgatactgtgagaagagcatgatcagcagaaagctctttggattcactgaacggtacggagcagtgttctcatcccgggagcagcccaaactggctgggtttcagcaattcctgcagagcctgcagcccaggacgactgaagctcttgcagcccctgcagacgagagtcaggccagcaccctgcgaccagcttctccactgatgcacatccaaggcttcctggcagctctcactacggccaaccaggacggcagggtcatcctgagccgccaaggcagcctcagtcagagcaccctgaagtttttgctcctgaatccagctgtgcactttgcccaagtggtgaaggaatgccgggcagtggtcattgcggggggtaccatgcagccgcccagacttctcgcttcctttctgctgggcctctgaggggtcatggggccgtgacgctgtggccttggtctacaggtgtctgacttccggcagcagctgctggcctgtgccggggtggaagctgagcgcgtggtggagttttcctgtggtcacgtgatccctccagacaacatcctgcccctcgtcatctgcagcgggatctccaaccagccgctggaattcacgttccagaaaagagagctgcctcagatgatggacgaggtgggtcgcattctctgtaacctgtgcggtgtggttcctggaggggtggtctgtttcttcccctcctacgagtacctgcgccaggtccatgcccactgggagaagggtggcctgctgggccgtctggctgccaggaagaagtttcaccgggagaagtcggcctcttcctgatgggcaaccacaccactgcctggcgccgtgcccttcctttgtcctgcccgctggagacagtgtttgtcgtgggcgtggtctgcggggatcctgttacaaaggtgaaacccaggaggagagtgtggagtccagagtgctgccaggacccaggcacaggcgttagctcccgtaggagaaaatgggggaatcctgaatgaacagtgggtcctggctgtccttggggcgttccagggcagctcccctcctggaatagaatctttctttccatcctgcatggctgagagccaggcttccttcctggtctccgcaggaggctgtggcagctgtggcatccactgtggcatctccgtcctgcccaccttcttaagaggcgagatggagcaggcccatctgcctctgccctttctagccaaggttatagctgccctggactgctcactctctggtctcaatttaaaatgatccatggccacagggctcctgcccaggggcttgtcaccttcccctcctccttcctgagtcactccttcagtagaaggccctgctccctatcctgtcccacagccctgcctggatttgtatccttggcttcgtgccagttcctccaagtctatggcacctccctccctctcaaccacttgagcaaactccaagacaccttctaccccaacaccagcaattatgccaagggccgttaggctctcaacatgactatagagaccccgtgtcatcacggagacctttgttcctgtgggaaaatatccctcccacctgcaacagctgcccctgctgactgcgcctgtcttctccctctgaccccagagaaaggggctgtggtcagctgggatcttctgccaccatcagggacaaacgggggcaggaggaaagtcactgatgcccagatgtttgcatcctgcacagctataggtccttaaataaaagtgtgctgttggtt

SEQ ID NO: 125538 - DNA, 400 bp, Homo sapiens
  Payload ID: 4608
  Gene Symbol: DDX11
  Gene Name: DEAD/H (Asp-Glu-Ala-Asp/His) box helicase 11
  ENST ID: ENST00000544652
  CDS Start-End: 1-276
gagagtccaactggcactgggaagtccttaagtcttatttgtggggccctctcttggctccgtgactttgaacagaagaagcgtgaagaagaggcacgactccttgaaactggaactggccccttacatgatgagaaagatgaatccctgtgtctgtcttcttcctgcgaaggggctgcaggcaccccgaggcctgctggagaaccggcctgggttactcagtttgtgcagaagaaagaagagagggacctggtggaccgactaaagagtggatgaggatgaggatgacctggaggaagaacacataactaagatttattactgtagtcggacacactcccagctggcccagtttgtgcatgaggtgaagaagagcccctttggcaaggatgttcggctg

SEQ ID NO: 125539 - DNA, 3793 bp, Homo sapiens
  Payload ID: 4609
  Gene Symbol: DDX26B
  Gene Name: DEAD/H (Asp-Glu-Ala-Asp/His) box polypeptide 26B
  Uniprot ID: Q5JSJ4
  ENST ID: ENST00000370752
  CDS Start-End: 335-2920
cagtctggggcgagcgctctagtgagcgcggacggatgcttaggcagtagtcctggcagcggcagtagtggtggcagcagaagagaggaagggggagggccccgagggctacacacgctcacactttcaagttcccttggagggagaggaggtggggctgcagaaagaggaggccaggagcggtcccatccgtcccgtcccgtcccgtctccccctcttcctcttgctccttgctccccggctctgcgagagttgagggttcaggtggccgtacgcggcagtgagggcaagagggccgggagagtggggagcggaggcaggagtgcgggggaagatgcccatcctgctgttcctcatagacacgtccgcctctatgaaccagcgcactgacctgggcacctcttatttggacattgccaaaggcgctgtggagttattcttgaagctgcgcgcccgggacccggccagccgtggagacaggtacatgctggtcacctacgacgaacccccgtactgcatcaaggctggttggaaggaaaatcatgcaacattcatgagcgaactaaaaaatcttcaggcttctggactgactactctcggtcaggctctaagatcctcatttgatttgttaaatctcaatagattaatatctggaatagacaattatggacaggggagaaatccattttttttagaaccatctattttaattaccatcacagatggaaacaagttaacaagtactgctggtgttcaagaagagctccatcttcctttgaattcccctctgcctggaagtgaactaaccaaagaaccttttcgttgggatcaaaggttatttgccctggtgttgcgtttgcctggagtggcttctaccgaaccagagcaactagggagcgtaccaactgatgaatctgccatcacacagatgtgtgaagtcacaggaggtcgctcctactgtgtgagaacacaaagaatgttgaatcaatgtttagaatctctagttcaaaaagttcagagtggtgtagttattaattttgaaaaaacaggaccagatccacttcctattggagaagatggacttatggattcatccaggccaagcaattcatttgctgctcagccatggcatagttgtcataaactcatttatgtacgacctaactctaaaactggtgttcctgttggacattggccaattccagaatctttttggccagatcagaatttaccttcactacctccacgaacatctcatcctgttgtgaggttctcctgtgtagattgtgagccaatggtaatagacaaacttccttttgacaaatatgaacttgaaccttcgcccttaactcagtatatcttggaacgaaagtctccccatacctgctggcaggtatttgttactagcagtggaaagtacaatgaacttggatatccatttggttatttaaaagccagtacaactttaacttgtgtaaacctctttgtgatgccttacaactacccagttttacttcctcttttagatgacttgtttaaagttcacaagcttaagccaaatctgaagtggcgacaggcttttgacagctacttaaaaactctgcctccatactacctattaaccaaactagagtcagaacgaatactagcatcagtggggaagaaacctccccaggaaattggaattaaagtgaaaaatcattctggaggtggcatgtccttgactcacaataaaaattttagaaaactattgaaagaaatcacaggggaaactgcacttagactgacagaattgaacaccaaagaatttgctggcttccaaattgggctcttaaacaaggatttgaaacctcagacatacagaaatgcttatgatattccccgtagaggtcttttagaccagctgaccagaatgagatccaatctgctgaaaacgcacaagtttattgttggacaagatgaagattcccttcatagtgttccagttgcacaaatgggtaactatcaggaatatctgaagacattggcttctccactgcgagagattgatccagaccaacccaaaagactgcatacttttggcaatccgtttaaacaagataagaagggaatgatgattgatgaagcagatgagtttgtagcagggccacaaaacaaagtgaaacgtccaggggaacccaacagtcctatgtcatctaagagaaggcggagtatgtccctgctgttgaggaaaccacaaacaccacctactgtaactaaccatgtgggcggaaagggaccaccctcagcctcgtggttcccatcttatccaaacctcataaaacccacccttgtacatacagatgctactatcattcacgatggccatgaggagaagatggaaaatggtcagatcacacctgatggcttcctgtcaaaatctgctccatcagagcttataaatatgacaggagatcttatgccacccaaccaagtggattctctgtctgacgacttcacaagtctcagcaaagatgggctgattcaaaaacctggtagtaacgcatttgtaggaggagccaaaaactgcagtctctccgtagatgaccaaaaagacccagtagcatctactttgggagctatgccaaatacattacaaatcactcctgctatggcacaaggaatcaatgctgatataaaacatcaattaatgaaggaagttcgaaagtttggtcgaaaatatgaaagaattttcattttgcttgaagaagtgcaaggacctctggagatgaagaaacagtttgttgaatttaccatcaaggaagccgcaaggtttaaaagacgagtcctaattcagtaccttgagaaggtactagaaaaaataaattcccaccaccttcacaacaacattagtcacatcaacagcagatcatcatgttagtgcaaagaccagtgagaaaaaaatgacaagttttctgtgctgtaggatggaacaggatattgttgaagcctcctggaatgtttgagtcaagggaattgctttccagatgctaagaagcagcagtggggcttttgaattttatgattatctggcagtgaaagctgggcttttgccttaataattttttaaagtatgaattgttttgttttgttttcctcaattgaggaagctgatgttattaattcacaggctaaattcggtaaacaccactgcccctaccacgggtaatgagaggtcactcacttgaactttgccattccaggcattctcagagtggcgaggggccacctgcaagtggagcacaacttggtgctcttactgtgtccttcagaaagaataggtgtacagaaaggaaatggcaatcttatgtgtgctgaacaaagttttcaacaattcctagttgtgccttttaaaccatgcaatattcaggatagtttgaatcaaagaagtaagaagctgctatttgggtaacttatttctctgtgggaaggggcagggagagtcaccaaacaatctacctccaactctcttctcttttgtctagagacattacaaagtgcacttgaggctgcccccaacctctgacatttgttcttgcatgtgatgatagaaagtcttcagatggacttatacattctgtgctttggaagcacaagaagaacaaaatatgtgtatatttcctttaatgtttatacaaaagtttatatggagcagtattgttatgtttgtatgaatttgcaaaaattaaagtgtacaaagagattttgattttgcatatataaaataaatcattttattgattttcacaagttc

SEQ ID NO: 125540 - DNA, 2500 bp, Homo sapiens
  Payload ID: 4610
  Gene Symbol: DEAF1
  Gene Name: DEAF1 transcription factor
  Uniprot ID: O75398
  ENST ID: ENST00000382409
  CDS Start-End: 486-2183
aaacccgcggcactaagctctctctgagaggcagaattgcgccggccgccggcgagaatctgcctagagccgtccagccctgtcggccggggacgacagccgcctcagcctgtcaggacagtgaggagagcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgaggcggcggcggtggcggccgcggccgctgtggcggcggcggccgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 125541 - DNA, 1623 bp, Homo sapiens
  Payload ID: 4610
  Gene Symbol: DEAF1
  Gene Name: DEAF1 transcription factor
  ENST ID: ENST00000527170
  CDS Start-End: 1-1048
tctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaagagatggagtcttactatgttgaccagcctggtctccatctcctggcttcgggcgatcctcccatgtcagcctcccaaagtgctaggattataggcatgaggcactacaccagccaacagaagtttttatattaaaatttactttttctagctgggcacagtggctcacgcctgtcatcccagcactttgggaggctgaggcaggtggatcaccggtcgggagtttgagaccagcttggctaacatggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 125542 - DNA, 705 bp, Homo sapiens
  Payload ID: 4610
  Gene Symbol: DEAF1
  Gene Name: DEAF1 transcription factor
  ENST ID: ENST00000529717
  CDS Start-End: 1-259
gccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcaggcaagtgcgcccgccggcctctcgcctcgtccggttcccgcgcgcctaccccgcgcgcctgccccgcacaactgtcccagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagcc

SEQ ID NO: 125543 - DNA, 485 bp, Homo sapiens
  Payload ID: 4610
  Gene Symbol: DEAF1
  Gene Name: DEAF1 transcription factor
  ENST ID: ENST00000634194
  CDS Start-End: 1-485
tgttgacatccctgcctgcgctggcggtcccacccccgactcccaccaaaacggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggaggtgatccacccgcctcggctgcccaaagtcctgggattacagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtga

SEQ ID NO: 125544 - DNA, 760 bp, Homo sapiens
  Payload ID: 4610
  Gene Symbol: DEAF1
  Gene Name: DEAF1 transcription factor
  ENST ID: ENST00000632113
  CDS Start-End: 1-443
tgttgacatccctgcctgcgctggcggtcccacccccgactcccaccaaaacggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 125545 - DNA, 1006 bp, Homo sapiens
  Payload ID: 4610
  Gene Symbol: DEAF1
  Gene Name: DEAF1 transcription factor
  ENST ID: ENST00000634067
  CDS Start-End: 1-431
tgttgacatccctgcctgcgctggcggtcccacccccgactcccaccaaaacggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaagagatggagtcttactatgttgaccagcctggtctccatctcctggcttcgggcgatcctcccatgtcagcctcccaaagtgctaggattataggcatgaggcactacaccagccaacagaagtttttatattaaaatttactttttctagctgggcacagtggctcacgcctgtcatcccagcactttgggaggctgaggcaggtggatcaccggtcgggagtttgagaccagcttggctaacatggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtcttgcccacagggcctgtgctgcgacgcacatacatacgtgttgtgtctgtcaataaagtgtaaataaggtc

SEQ ID NO: 125546 - DNA, 2590 bp, Homo sapiens
  Payload ID: 4611
  Gene Symbol: DFNA5
  Gene Name: deafness, autosomal dominant 5
  Uniprot ID: O60443
  ENST ID: ENST00000342947
  CDS Start-End: 427-1917
agaaagcaatgtttgagcaccagctatgctgagattccctcgttcagtattcgttgagcacccagtgtgtgagagcgcctggttttgccctcaaggagcttagagtggagtttacaggaatgaatcactgattagcggcaggcctaagtgtgggcactgtcgcaccacacacccagatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatgtc

SEQ ID NO: 125547 - DNA, 1689 bp, Homo sapiens
  Payload ID: 4611
  Gene Symbol: DFNA5
  Gene Name: deafness, autosomal dominant 5
  Uniprot ID: O60443
  ENST ID: ENST00000409775
  CDS Start-End: 168-1658
ggggcgcccggaccgagcaaaggtcccggcgggcgggccctctctccgccctccccaagcgcccgccccccgccggcccagcgcaggctcctccgactccgccagcgcagggggcgcggctgccggggacccagcagcgggcgcgcggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttact

SEQ ID NO: 125548 - DNA, 2005 bp, Homo sapiens
  Payload ID: 4611
  Gene Symbol: DFNA5
  Gene Name: deafness, autosomal dominant 5
  Uniprot ID: O60443
  ENST ID: ENST00000409970
  CDS Start-End: 362-1360
cccgccggcccagcgcaggctcctccgactccgccagcgcagggggcgcggctgccggggacccagcagcgggcgcgcggtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtat

SEQ ID NO: 125549 - DNA, 500 bp, Homo sapiens
  Payload ID: 4611
  Gene Symbol: DFNA5
  Gene Name: deafness, autosomal dominant 5
  ENST ID: ENST00000415480
  CDS Start-End: 1-467
cagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgaaggatatcctggggaggtcaagttccttaactcttagttgtacaaatggtgagagccacacaagctgccaaccctccagccacccagattctgtgtcctccctttcttaaggctgaggctttataaacctgattttgactaca

SEQ ID NO: 125550 - DNA, 450 bp, Homo sapiens
  Payload ID: 4611
  Gene Symbol: DFNA5
  Gene Name: deafness, autosomal dominant 5
  ENST ID: ENST00000430096
  CDS Start-End: 1-168
cagctgtttatgacagcctacttcttggtcagtgccctcgcagaaatgccagatagcgcagcagctctgctgggcacttgctgcaaactccagatcattcccacactgtgccacttggtaagcaacctcccaggtgggaccttagaatggataggaatggggaaatgatgagggggtagacatccagcagccggtaaaacacctctaggacttaccacaacagctcttcaagacacattaagtaagtattgttattaaccccacttttatacacatcccaccccatgggaagactgagacccagaggaaaatgatttgtccaaataacttgttagcaggtccaggacttcatccttgtctttcgactccaactcttatacttttcccattgtttggagagaattttggccaaggtttggtgttacattacaataaaggggcctgacacca

SEQ ID NO: 125551 - DNA, 610 bp, Homo sapiens
  Payload ID: 4611
  Gene Symbol: DFNA5
  Gene Name: deafness, autosomal dominant 5
  ENST ID: ENST00000446822
  CDS Start-End: 1-578
tcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgcagaaggatatcctggggaggtcaagttccttaactcttagttgtacaaatggtgagagccacacaagctgccaaccctccagccacccagattctgtgtcctccctttcttaaggctgaggctttataaacctgattttgactac

SEQ ID NO: 125552 - DNA, 2265 bp, Homo sapiens
  Payload ID: 4611
  Gene Symbol: DFNA5
  Gene Name: deafness, autosomal dominant 5
  Uniprot ID: O60443
  ENST ID: ENST00000419307
  CDS Start-End: 596-1594
aggagcttagagtggagtttacaggaatgaatcactgattagcggcaggcctaagtgtgggcactgtcgcaccacacacccagatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccggtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatg

SEQ ID NO: 125553 - DNA, 571 bp, Homo sapiens
  Payload ID: 4611
  Gene Symbol: DFNA5
  Gene Name: deafness, autosomal dominant 5
  ENST ID: ENST00000414428
  CDS Start-End: 516-571
cagatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccggtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcat

SEQ ID NO: 125554 - DNA, 734 bp, Homo sapiens
  Payload ID: 4611
  Gene Symbol: DFNA5
  Gene Name: deafness, autosomal dominant 5
  ENST ID: ENST00000411476
  CDS Start-End: 1-651
gtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgcccccctatgtctgccttggtggtcctgtccagtcttactgatggccagtggtgaatgtgtcactcccccgcagcttactgagagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagagg

SEQ ID NO: 125555 - DNA, 2847 bp, Homo sapiens
  Payload ID: 4612
  Gene Symbol: DFNB31
  Gene Name: deafness, autosomal recessive 31
  ENST ID: ENST00000265134
  CDS Start-End: 599-2173
gaaactcctaggcagcagaggcccacgactacttcctcctgagtgccgttcagtggcctgtgtccaggctctgaagggctccaagaagctggtgctgtctgtgtactcagcagggcgcatccctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgaacctggtgctgggggacggccggtccctgggcctcacgatccgtgggggagctgagtacggccttggcatttacatcactggcgtggacccaggctctgaagcagaaggcagcgggctcaaggttggggaccagattctagaagtgaatgggcggagctttctcaacatcctacacgacgaggctgtcaggctgcttaagtcatctcggcacctcatcctgacagtgaaggacgtcgggaggctgccccatgcccgcaccactgtggacgagaccaagtggatcgccagttcccggatcagggagaccatggcgaactcggcagggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggtggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccagctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggtta

SEQ ID NO: 125556 - DNA, 3566 bp, Homo sapiens
  Payload ID: 4612
  Gene Symbol: DFNB31
  Gene Name: deafness, autosomal recessive 31
  ENST ID: ENST00000362057
  CDS Start-End: 170-2893
gtctccgcgaccccctaggatccagccactgtacccgtgctccccaaacccaggctccagccgtcgtctccgcgctcccggggatccagctgtcgcgccagtacccgcgaggacagcggcaccgcccacaccccgcgcgctcagagcccggccgggcctcggcgtggagatgaacgcgccgctggacggcctgtcggtgagctcgtcctccaccggctcgctgggctcggcggccggggcgggcggcggcgggggcgcggggctgcggttactgtctgccaacgtgcgccagctgcaccaagcgctgaccgcgctgctgagcgaggcggagcgggagcagttcacccactgcctgaacgcttaccacgcgcgccgcaacgtcttcgacctggtgcgcaccctgcgcgtgctgctggacagtccggtcaagcggcgcctgctgcccatgcttcgtctggtcatcccgcgctccgaccagctgctcttcgaccaatacacggccgagggcctctacctgcccgccaccaccccctacaggcagcccgcctggggcggccccgacagcgcggggccaggggaggtgcgcctggtgagtttgcggcgtgccaaggcccacgagggcttgggcttcagcatccgtgggggctcggagcacggcgtgggcatctacgtgtctctggtggaaccaggctctctagctgagaaggaaggactgcgggtcggggaccagattctgcgcgtcaacgacaaatccctggcccgggtgacccacgcggaggccgtcaaggctctgaagggctccaagaagctggtgctgtctgtgtactcagcagggcgcatccctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgaacctggtgctgggggacggccggtccctgggcctcacgatccgtgggggagctgagtacggccttggcatttacatcactggcgtggacccaggctctgaagcagaaggcagcgggctcaaggttggggaccagattctagaagtgaatgggcggagctttctcaacatcctacacgacgaggctgtcaggctgcttaagtcatctcggcacctcatcctgacagtgaaggacgtcgggaggctgccccatgcccgcaccactgtggacgagaccaagtggatcgccagttcccggatcagggagaccatggcgaactcggcagggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggtggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccagctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggtt

SEQ ID NO: 125557 - DNA, 1718 bp, Homo sapiens
  Payload ID: 4612
  Gene Symbol: DFNB31
  Gene Name: deafness, autosomal recessive 31
  Uniprot ID: Q9P202
  ENST ID: ENST00000374057
  CDS Start-End: 650-1687
agttcgcaaagtccgggcttgcggccgggcggcgcagaggcgcggaggctccccgggcggctgcatcccggggctgccccggacatgccccgcaccccttgtcggacgcccgcgccgcttcaccggctgccactccccggagtgctctgggactagagcgccctccgccccaacttctgactttggggtcccccagccctagaggaacgggcgcccggctgggggagccccgggcatggtgtgacggggcagtcaggtcagctttgcggcgcccccaaactccagccacccgtcgtctccgtgccctccagaatgtagctgctgaccccgcgccccccggactccagcagcagtctccgccacctccgggctccagcagccaactcttgtgtctctcaggaacccgccgacgtctccgcgtcccccggattccaggttcgcgacccccgccgtcttcgcgcctccgggactctagcagcggtctccgcgaccccctaggatccagccactgtacccgtgctccccaaacccaggctccagccgtcgtctccgcgctcccggggatccagctgtcgcgccagtacccgcgaggacagcggcaccgcccacaccccgcgcgctcagagcccggccgggcctcggcgtggagatgaacgcgccgctggacggcctgtcggtgagctcgtcctccaccggctcgctgggctcggcggccggggcgggcggcggcgggggcgcggggctgcggttactgtctgccaacgtgcgccagctgcaccaagcgctgaccgcgctgctgagcgaggcggagcgggagcagttcacccactgcctgaacgcttaccacgcgcgccgcaacgtcttcgacctggtgcgcaccctgcgcgtgctgctggacagtccggtcaagcggcgcctgctgcccatgcttcgtctggtcatcccgcgctccgaccagctgctcttcgaccaatacacggccgagggcctctacctgcccgccaccaccccctacaggcagcccgcctggggcggccccgacagcgcggggccaggggaggtgcgcctggtgagtttgcggcgtgccaaggcccacgagggcttgggcttcagcatccgtgggggctcggagcacggcgtgggcatctacgtgtctctggtggaaccaggctctctagctgagaaggaaggactgcgggtcggggaccagattctgcgcgtcaacgacaaatccctggcccgggtgacccacgcggaggccgtcaaggctctgaagggctccaagaagctggtgctgtctgtgtactcagcagggcgcatccctgggggctacgtcaccaaccacatctacacctgggtggacccgcagggccgcagcatctccccaccctcgggcctgccccagccccacggtggtgccctgaggcagcaggagggtgaccggaggagcaccctgcacctcctgcaaggaggggatgagaaaaaggtgagtggggtggggaaaggaggccagcctctcagacaccgtattctccctccgaacccagaacagcagagctgcttggaggccgcaagaagaggctggttctgtccaggctctgtcttccctcaagtctgtactgaagggtggtgttttttctttgcttttctttttgacctgtgtagtgtatgttataatacaggctaagctgccacaataaaagagcttaaatactgtg

SEQ ID NO: 125558 - DNA, 3278 bp, Homo sapiens
  Payload ID: 4612
  Gene Symbol: DFNB31
  Gene Name: deafness, autosomal recessive 31
  ENST ID: ENST00000374059
  CDS Start-End: 935-2605
catgacctgggcacatccctctcctctcttggcctcagtttccccatggaaagctgaaatacaccatccaactgtctcattctttatttgtccccaaattacttaactcattctatagaccttagttgcttcatccaaaaagtggggaccataaccctgccctcatcccagatctgtgcagatgaaagagagggagggagagggaaagagagagatgctttggggtgtatttggccagaggccaccaggctggatcccatgaagaaatctgggtgagagggtcttaaagtcataaactgagatccagttgccaggtggctgcatagttgccaacagtgtaatgtgtcaccttttgatcttcatcagaaatctcaggctggtggccacctggccaaatacactgcagagcatgtctgtctgtctgtctgtctgtgtctctctgtgtgtgtgtgtgtgtgtgtgtgtgtgtgtgtgtgtgtgtgtgtctcccccttcccttcctttcacctgcatagtattaaacattttcaaagttacttgccaacatctagaaagataccaggttttctataaaaaaaaaaactggatttctggatgcttcttaaaaatcaggaagtctggcagcctgagcccacatcggctggagctgagccgcacctgcgagttgcatctgggatctccagttcaccggcccctaagctcctgagggttggcctgaccctgaggttgcctgtcaatcaccatttcttccctccactccttgtgttacctgcctggtcctgcggggttggcaacaactcaggagcccacctcgggtggttttggaggtgccgtgcacactgctgattgggaggctggacgctgccagtctgtccggagtttcctttacccctgagtagcccccagactgaactggcagcgagtggaggccacgatgcatggttctcttgaagctttgctcttcctgccccaagtcaccctgtcccttgcccacgcccatttgatctgctcaaatgcacaactggagatgtgtgtctttccccacaggtttcttggcgatctcacaacagaaggaataaacaagccaggattttacaagggcccagccggctcccaggtgaccctgagcagcctggggaaccagacacgagtgctgctggaggagcaggctcggcacctgctgaacgagcaggaacacgccaccatggcctactacctggatgagtaccgtggtggcagcgtctctgtggaggccctcgtcatggccctgttcaagctgctcaacacccacgccaagttctcactcctctctgaggtgagaggcaccatttccccgcaagacctagaacgcttcgaccacctggtgctgaggcgtgagattgagtccatgaaggcgcggcagcccccaggccccggggctggggacacctactccatggtctcctacagtgacacgggttcatccacaggcagccacggcacctccaccaccgtcagctcggccaggaacactctggacctggaggaaactggcgaggctgtccagggcaatatcaacgccctcccagatgtgtccgtggatgatgtcagatccacctcccaggggctgtcaagcttcaagccactgcctcgcccaccacctctggcccaaggcaacgacctcccactaggccagccaaggaagctggggagagaggacctccagccaccttcctccatgccttcctgctcgggcactgtcttctcggctccacagaaccgcagcccgccagcgggcaccgcacccaccccagggacctcctctgcacaggacttgccctcttcccccatctatgcctccgtctcccctgccaaccccagctccaagaggccgctggacgcccatctggccctggtcaaccaacaccccatcggccccttcccacgggtccagtcacccccgcacctgaaaagcccctctgcagaggccacagtggctgggggctgccttctgcccccatcaccctctggccacccagaccagacaggcacaaaccagcactttgtcatggtggaggtccaccgccccgacagcgagccagacgtcaatgaagtgagggcgctgccccagacgcgcacagcctctacgctctcccagctctcggacagcgggcagactctaagcgaggacagtggtgtggatgctggcgaggcagaggccagcgccccaggccgaggaaggcagtcggtgtccaccaagagcaggagtagcaaggagctgcctcggaacgagaggcccacagatggggccaacaaaccgcctggacttctggagcccacgtccactctggtccgtgtgaagaaaagtgcggccaccctgggcatcgccatcgagggtggcgccaacacccgccagcccctgcctaggattgtcactattcagagaggcggctcagctcacaactgtgggcagctcaaggtgggccacgtgattctggaagtgaatgggctgacgcttcggggcaaggagcaccgggaggccgcccgcattatcgccgaggccttcaagactaaggaccgtgactacattgactttctggtcactgagttcaatgtgatgctctagaggccaaggcctgagggcctcccaccactgcccagcccctggtcccagtccctttccaccgttggcttcatcaagctccttgcggggttggggctgcatggccagggtggcaggaagacatcccccctccatcccagcccactggaccagaactgggagaggaagagagcaggacaaggcagacagaaggtcaggtcaggaactggtgctgtactgggtacacagtaggcgcccaggacaagtgggttgcaagacaggaagaaaggaaaaggaagggcagagtgctggtttctccaggttgggttgggggcactgctgtcccccctccagctaggacccagcccatccccagatgcctgagcctttgtccaaagtgaggtcactcgagaattcatggacacggcccccagtcagggggcatcttgcaagacctttagtgccacaaataagcatcgagcacctccccattcacacccccattcctcctggctccttatcccccatggtgtttattatttatttccctccccatgcccctggggaccccaaggccccagcttccctctgcacccccagcctatcccagaggccttgcaggtgaccagcagtgtcattgtatttatatacagagcttatgactttaatttttcaataaagaaatctgaacaaggtt

SEQ ID NO: 125559 - DNA, 1202 bp, Homo sapiens
  Payload ID: 4613
  Gene Symbol: DFNB59
  Gene Name: deafness, autosomal recessive 59
  Uniprot ID: Q0ZLH3
  ENST ID: ENST00000375129
  CDS Start-End: 144-1202
aaactacttggtgaaaccatgctttgtatttttaagatgtataattatatttaaaaacaagcaatgcttaattttgtgcctgattttcctctttaaaaatggatttatctgggggttgcagttgatgacgttttgattttaatatgtttgctgctgctaccaagagctttgtcaagcaagttggagatggagggagattagttcctgttccaagcctcagtgaagctgacaaatatcaacctctaagtctggtggtaaaaaagaagcgatgctttctgtttcctagatataaatttacttcaacaccttttacactgaaagatattctcctaggagacagagaaatttcagctggtatttcatcttatcaattactgaattatgaagatgaatcagatgtttcactctatggaaggcgaggtaaccatattgtaaatgacgttgggattaacgttgctggatcagattccattgcagtgaaagcttcatttggtatagtaaccaaacatgaagtggaagtatcaacattactcaaagaaattactacacgaaaaattaactttgaccacagcttgatacgtcagtcaaggagcagcagaaaggcagtattgtgtgtggtcatggagagcatccgaaccacacgacagtgctcactgtctgtgcatgctggaattcgaggggaagcaatgcggtttcactttatggatgaacagaatcccaagggaagggacaaagctattgttttcccagcacatacaaccatagctttcagtgtttttgaactcttcatatacctggatggtgcctttgacctttgtgtcacttcagtgtcaaaaggaggatttgaaagggaagaaacggcaacatttgcactgctgtacaggttgagaaatatcctatttgaaagaaatagaagagtgatggatgtcatttctcgttcacagctttacttggatgatcttttttctgactactatgacaaacctctcagcatgactgatatttcactcaaagaagggacccatatccgagttaacttacttaatcacaacattcccaaagggccttgcatactctgtggaatggggaacttcaaaagggagacagtttatgggtgctttcagtgttctgttgatggtcagaagtatgtgagacttcatgcagttccttgttttgatatttggcacaagaggatgaaataa

SEQ ID NO: 125560 - DNA, 1531 bp, Homo sapiens
  Payload ID: 4613
  Gene Symbol: DFNB59
  Gene Name: deafness, autosomal recessive 59
  Uniprot ID: Q0ZLH3
  ENST ID: ENST00000409117
  CDS Start-End: 357-1415
tttcttgccgggagagagggattagagggattgtccggcgtgggtctagggtcgttgaggcctaaagttaagcctttgtggggaggacggattgggggctgggtcactttaagaaaaagattctaaaattacgaaggcagaattccagggagtctcccgggcctggtcctgaagcttgagaccccggatatatacgctccagggggctgcggtgcgctcttcgggtccccgagccctgtgtttaggaacacgcggggacgtccaaacacccgctcctctcccgccgggcgggctcctttgtcttctgggctttcgtcgcgagatggaacgctggttgatgacgttttgattttaatatgtttgctgctgctaccaagagctttgtcaagcaagttggagatggagggagattagttcctgttccaagcctcagtgaagctgacaaatatcaacctctaagtctggtggtaaaaaagaagcgatgctttctgtttcctagatataaatttacttcaacaccttttacactgaaagatattctcctaggagacagagaaatttcagctggtatttcatcttatcaattactgaattatgaagatgaatcagatgtttcactctatggaaggcgaggtaaccatattgtaaatgacgttgggattaacgttgctggatcagattccattgcagtgaaagcttcatttggtatagtaaccaaacatgaagtggaagtatcaacattactcaaagaaattactacacgaaaaattaactttgaccacagcttgatacgtcagtcaaggagcagcagaaaggcagtattgtgtgtggtcatggagagcatccgaaccacacgacagtgctcactgtctgtgcatgctggaattcgaggggaagcaatgcggtttcactttatggatgaacagaatcccaagggaagggacaaagctattgttttcccagcacatacaaccatagctttcagtgtttttgaactcttcatatacctggatggtgcctttgacctttgtgtcacttcagtgtcaaaaggaggatttgaaagggaagaaacggcaacatttgcactgctgtacaggttgagaaatatcctatttgaaagaaatagaagagtgatggatgtcatttctcgttcacagctttacttggatgatcttttttctgactactatgacaaacctctcagcatgactgatatttcactcaaagaagggacccatatccgagttaacttacttaatcacaacattcccaaagggccttgcatactctgtggaatggggaacttcaaaagggagacagtttatgggtgctttcagtgttctgttgatggtcagaagtatgtgagacttcatgcagttccttgttttgatatttggcacaagaggatgaaataaaatgaaaaatgaatacaccgtgttggtgttttaggtgcagttgtgccacaaaccttccctaaattatctaggtttgctttgatgaattaaattaaaatgagaaaagcaaaaagaaa

SEQ ID NO: 125561 - DNA, 471 bp, Homo sapiens
  Payload ID: 4613
  Gene Symbol: DFNB59
  Gene Name: deafness, autosomal recessive 59
  ENST ID: ENST00000444615
  CDS Start-End: 1-317
ccaaacatgaagtggaagtatcaacattactcaaagaaattactacacgaaaaattaactttgaccacagcttgatacgtcagtcaaggagcagcagaaaggcagtattgtgtgtggtcatggagagcatccgaaccacacgacagtgctcactgtctgtgcatgctggaattcgaggggaagcaatgcggtttcactttatggatgaacagaatcccaagggaagggacaaagctattgttttcccagcacatacaaccatagctttcagtgtttttgaactcttcatatacctggatggtgcctttggtctttaaggtctgttggccaactggaacaagtccaggtgtagcccaagggatcaggaaaggcagcccctagccatgacctttgtgtcacttcagtgtcaaaaggaggatttgaaagggaagaaacggcaacatttgcactgctgtacaggttgagaaatat

SEQ ID NO: 125562 - DNA, 713 bp, Homo sapiens
  Payload ID: 4613
  Gene Symbol: DFNB59
  Gene Name: deafness, autosomal recessive 59
  ENST ID: ENST00000442710
  CDS Start-End: 1-469
aacaccttttacactgaaagatattctcctaggagacagagaaatttcagctggtatttcatcttatcaattactgaattatgaagatgaatcagatgtttcactctatggaaggcgaggtaaccatattgtaaatgacgttgggattaacgttgctggatcagattccattgcagtgaaagcttcatttggtatagtaaccaaacatgaagtggaagtatcaacattactcaaagaaattactacacgaaaaattaactttgaccacagcttgatacgtcagtcaaggagcagcagaaaggcagtattgtgtgtggtcatggagagcatccgaaccacacgacagtgctcactgtctgtgcatgctggaattcgaggggaagcaatgcggacctttgtgtcacttcagtgtcaaaaggaggatttgaaagggaagaaacggcaacatttgcactgctgtacaggttgagaaatatcctatttgaaagaaatagaagagtgatggatgtcatttctcgttcacagctttacttggatgatcttttttctgactactatgacaaacctctcagcatgactgatatttcactcaaagaagggacccatatccgagttaacttacttaatcacaacattcccaaagggccttgcatactctgtggaatggggaacttcaaaagggagacagtttatgggtgctttcagtgttctgt

SEQ ID NO: 125563 - DNA, 455 bp, Homo sapiens
  Payload ID: 4614
  Gene Symbol: DHX57
  Gene Name: DEAH (Asp-Glu-Ala-Asp/His) box polypeptide 57
  ENST ID: ENST00000442331
  CDS Start-End: 1-156
aaaaagctggaatttgcattcgcaaacagtgattatctggcccttctacaagcgtataagggatggcagctaagtacaaaagaaggcgtgcgtgcaagttataattactgcagacaaaacttcttgtctggaagagttctgcaggaaaagagatgagccagcaagaccataatgaaggagaaagaggaaacattctgctgagttccactgagagcacgaaccactctaggcctgagtaaggaactgagaggacaggagcaaaaatgcaagtaggaaaagctaggtagtagacagtgccgcagcacttggagttggaattccagtcaaaacaaacagcattttttgctgtcctaagaatttcgtggaaaatcaggcctacccaaaatccaatgagagtgtttaaaattgtaatctagagttaaataaatgatccttggatttattgaatttttgca

SEQ ID NO: 125564 - DNA, 2559 bp, Homo sapiens
  Payload ID: 4614
  Gene Symbol: DHX57
  Gene Name: DEAH (Asp-Glu-Ala-Asp/His) box polypeptide 57
  ENST ID: ENST00000452978
  CDS Start-End: 1-1996
tgacttcttgctgctagttttgaaggacattgtatcgcagaggccaggtcttcaagttattttaatgagtgcaactctaaacgctgagcttttttcagactattttaattcctgccccgttattactataccaggtcgtacatttcctgttgatcaattttttttggaagatgcaattgctgtgacaaggtatgtattacaggatgggagcccatatatgcggtccatgaaacagatttcaaaggaaaagcttaaagcaaggcggaacagaactgcatttgaagaagtggaagaagacctaaggctctcccttcacctccaggatcaggattctgtcaaagatgcagtgccagatcaacagttagattttaagcagctcctggcccgctataaaggggttagcaagtcagtcatcaaaacaatgtccatcatggattttgaaaaggtgaatcttgaattaatagaggccttattagagtggattgtggatggaaagcactcctaccctccaggtgctatacttgtatttttaccaggactagcagaaatcaaaatgctttatgaacagctacagtctaattctcttttcaacaacagacgtagtaatcgatgtgttattcacccacttcattcatctttatccagtgaagagcagcaggctgtgtttgtaaaacctcctgcaggagtaactaagattataatttccaccaacattgctgagacatccataaccatcgatgatgttgtctatgttatcgattctgggaaaatgaaagaaaagagatatgatgccagcaaagggatggaaagtctagaggacacctttgtatctcaagctaatgctctacaaaggaaaggccgagcaggccgtgttgcatctggggtctgcttccatttattcactagccatcactacaatcaccagcttttaaaacaacagctaccagaaatacaaagagtgccattggaacagctgtgtctaagaattaaaattttagagatgtttagtgctcataatctccagtctgtgttctctcggctcattgaacctccacacaccgattctcttcgtgcctcaaaaatacgattacgagacttaggagcattaactccagatgaaagattgacccctcttgggtatcatttggcctctctgcccgtggatgtgagaattggcaaactaatgttgtttgggtctatcttccgctgtttggatcctgctctcaccattgctgccagtttggcttttaagtctccgtttgtatctccctgggataaaaaagaagaagctaaccagaaaaagctggaatttgcattcgcaaacagtgattatctggcccttctacaagcgtataagggatggcagctaagtacaaaagaaggcgtgcgtgcaagttataattactgcagacaaaacttcttgtctggaagagttctgcaggaaatggccagcctcaaacgacaattcacggaactgttatcggatatagggtttgcaagggaagggctcagagcaagggaaattgagaaaagggcccaaggaggagatggtgtcttagatgccacaggagaagaggcaaactcaaatgctgagaaccccaagctgatatcagcaatgctgtgtgctgctttgtatccaaatgtagtgcaggtgagacactttgacagcccctacctgttgtaccacgagaagataaaaactagtcgagtattcatccgagactgcagcatggtgtctgtgtacccgctggtcttgtttggaggaggccaagtgaatgtgcagcttcaaagaggagagttcgttgtctccctggatgatggttggatccgttttgtagctgcttcccatcaggtggctgaactggtaaaggagcttcgttgcgaacttgatcagcttctccaggataaaattaaaaacccaagcattgatctgtgtacgtgtcctcgaggatcccggatcatcagcacaattgtgaaacttgtcaccacacaataaaaagcagtcttagagagtgcttgctactcacctgcttctagctcacctgggaaataacagcagaacctctacctcgaactaaagacctattggggctggccctggtggaggagcccagggcatgaagcccaaggcagctgaggcagtgtatatacccttagggccatttctaacaaagccttggccactcccagcacaatttggagtgtcaagggtgagagcctaaaacccagcttgcctgtctttgtctctgtgattgttctggagtgaattaagttcacctgataactcaaaagtgaatgtataatacaattctgttttaatctgtgtattctttttctcctactttttactggggtgagaggggcatgaagagaaatacgccttttttttttttcttttcctgtcgccaaggctcgactgagagaagtcagaacagagaaggggaaaaaaaacccaaaattatgtgaacaagcaaaattaaaatttcattttaggctattggctactgagtaaacttgacttgtgaggggtttttatttttactcattaaaagtcaactt

SEQ ID NO: 125565 - DNA, 4859 bp, Homo sapiens
  Payload ID: 4614
  Gene Symbol: DHX57
  Gene Name: DEAH (Asp-Glu-Ala-Asp/His) box polypeptide 57
  Uniprot ID: Q6P158
  ENST ID: ENST00000457308
  CDS Start-End: 129-4289
agctgggccaccgcagggctgctccaagtgagaatcgtgagggtggccaagtccagtttggacctctgacccttgggcagcacctcccgacagccggctcgggacccaactctgcgagccaggtgaaaatgagttcttcagtaagaagaaaaggcaagccaggcaaaggaggtggaaaagggtcttctagaggaggaagaggaggcaggagtcacgccagtaaatctcatgggagtggtggcggtggcggtggtggtggtggtggaggtggcggcaacagaaaggcctccagtagaatatgggatgatggagatgacttttgtatcttcagtgaatcaaggcgcccttccagacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgcaaaaactttccaggtatggtttcaatactgaacgctgtcaagcggtcctgaggatgtgtgatggagatgtgggagcatcactagagcatctccttacccagtgtttttcagagacatttggagagaggatgaagatctctgaggcagtcaaccagataagcttggatgagtgtatggaacagcgacaggaagaggcatttgctctcaagtccatctgtggagaaaaatttatagaaagaattcagaacagagtctggaccattgggttagaactggagtatctgacaagtagattccgcaaatccaagccaaaagaaagtaccaaaaatgtacaagagaattcacttgaaatctgtaaattttacctcaaaggaaattgtaaatttggatcaaaatgcagattcaaacatgaagtgcccccaaatcaaattgttggaagaatagaaagaagtgtagatgattctcatcttaatgctattgaagatgcatcttttttatatgaacttgaaattcgattttctaaagaccacaaatatccctaccaagctccgctcgtggcattttattccaccaatgagaacctacctctggcttgtcgtttacatatttctgagtttctttatgacaaggccttgacatttgcggaaacttcggaacctgtcgtatattctttgataacccttttagaggaagagtcggaaatagtcaagttactaacgaatacccaccacaagtatagtgaccctcctgtgaactttctgccagtaccctctaggaccagaataaataatcctgcctgtcataaaacagtgattccaaataattcttttgtttctaatcaaattccagaagttgaaaaagcatcagaatctgaggagtcagatgaggatgacggtcctgcacctgttatagtagagaatgaaagctatgtgaaccttaagaaaaagatttccaaaagatatgactggcaggcaaagtcagtacatgctgaaaatggtaaaatctgcaagcagttccgaatgaaacaggcttccagacagttccagtccattctgcaagagaggcaatcactccctgcttgggaagaaagagaaaccattcttaacttattgcgtaagcaccaggtggttgtcataagtggtatgactggatgtgggaaaaccacacaaattccgcagtttattctggatgattctctgaatggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaagtcctcagccaccagactgttatactgcaccacgggagtgctgctgagaaggctagaaggagatacagctctacaaggagtttcccatatcattgttgatgaagttcatgagaggacagaagaaagtgacttcttgctgctagttttgaaggacattgtatcgcagaggccaggtcttcaagttattttaatgagtgcaactctaaacgctgagcttttttcagactattttaattcctgccccgttattactataccaggtcgtacatttcctgttgatcaattttttttggaagatgcaattgctgtgacaaggtatgtattacaggatgggagcccatatatgcggtccatgaaacagatttcaaaggaaaagcttaaagcaaggcggaacagaactgcatttgaagaagtggaagaagacctaaggctctcccttcacctccaggatcaggattctgtcaaagatgcagtgccagatcaacagttagattttaagcagctcctggcccgctataaaggggttagcaagtcagtcatcaaaacaatgtccatcatggattttgaaaaggtgaatcttgaattaatagaggccttattagagtggattgtggatggaaagcactcctaccctccaggtgctatacttgtatttttaccaggactagcagaaatcaaaatgctttatgaacagctacagtctaattctcttttcaacaacagacgtagtaatcgatgtgttattcacccacttcattcatctttatccagtgaagagcagcaggctgtgtttgtaaaacctcctgcaggagtaactaagattataatttccaccaacattgctgagacatccataaccatcgatgatgttgtctatgttatcgattctgggaaaatgaaagaaaagagatatgatgccagcaaagggatggaaagtctagaggacacctttgtatctcaagctaatgctctacaaaggaaaggccgagcaggccgtgttgcatctggggtctgcttccatttattcactagccatcactacaatcaccagcttttaaaacaacagctaccagaaatacaaagagtgccattggaacagctgtgtctaagaattaaaattttagagatgtttagtgctcataatctccagtctgtgttctctcggctcattgaacctccacacaccgattctcttcgtgcctcaaaaatacgattacgagacttaggagcattaactccagatgaaagattgacccctcttgggtatcatttggcctctctgcccgtggatgtgagaattggcaaactaatgttgtttgggtctatcttccgctgtttggatcctgctctcaccattgctgccagtttggcttttaagtctccgtttgtatctccctgggataaaaaagaagaagctaaccagaaaaagctggaatttgcattcgcaaacagtgattatctggcccttctacaagcgtataagggatggcagctaagtacaaaagaaggcgtgcgtgcaagttataattactgcagacaaaacttcttgtctggaagagttctgcaggaaatggccagcctcaaacgacaattcacggaactgttatcggatatagggtttgcaagggaagggctcagagcaagggaaattgagaaaagggcccaaggaggagatggtgtcttagatgccacaggagaagaggcaaactcaaatgctgagaaccccaagctgatatcagcaatgctgtgtgctgctttgtatccaaatgtagtgcaggtgaaaagcccagaaggaaaatttcagaagaccagtactggagctgtcagaatgcaaccaaaatcagctgagttgaagtttgtcaccaagaacgatggatatgtacacattcacccttcatcagtgaactatcaggtgagacactttgacagcccctacctgttgtaccacgagaagataaaaactagtcgagtattcatccgagactgcagcatggtgtctgtgtacccgctggtcttgtttggaggaggccaagtgaatgtgcagcttcaaagaggagagttcgttgtctccctggatgatggttggatccgttttgtagctgcttcccatcaggtggctgaactggtaaaggagcttcgttgcgaacttgatcagcttctccaggataaaattaaaaacccaagcattgatctgtgtacgtgtcctcgaggatcccggatcatcagcacaattgtgaaacttgtcaccacacaataaaaagcagtcttagagagtgcttgctactcacctgcttctagctcacctgggaaataacagcagaacctctacctcgaactaaagacctattggggctggccctggtggaggagcccagggcatgaagcccaaggcagctgaggcagtgtatatacccttagggccatttctaacaaagccttggccactcccagcacaatttggagtgtcaagggtgagagcctaaaacccagcttgcctgtctttgtctctgtgattgttctggagtgaattaagttcacctgataactcaaaagtgaatgtataatacaattctgttttaatctgtgtattctttttctcctactttttactggggtgagaggggcatgaagagaaatacgccttttttttttttcttttcctgtcgccaaggctcgactgagagaagtcagaacagagaaggggaaaaaaaacccaaaattatgtgaacaagcaaaattaaaatttcattttaggctattggctactgagtaaacttgacttgtgaggggtttttatttttactcattaaaagtcaacttaaaaaaa

SEQ ID NO: 125566 - DNA, 548 bp, Homo sapiens
  Payload ID: 4614
  Gene Symbol: DHX57
  Gene Name: DEAH (Asp-Glu-Ala-Asp/His) box polypeptide 57
  ENST ID: ENST00000619207
  CDS Start-End: 231-548
agaaggcgccgggactgtgccgctgcagctgggccaccgcagggctgctccaagtgagaatcgtgagggtggccaagtccagtttggacctctgacccttgggcagcacctcccgacagccggctcgggacccaactctgcgagccagacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgcaaaaactttccaggtatggtttcaatactgaacgctgtcaagcggtcctgaggatgtgtgatgga

SEQ ID NO: 125567 - DNA, 4109 bp, Homo sapiens
  Payload ID: 4614
  Gene Symbol: DHX57
  Gene Name: DEAH (Asp-Glu-Ala-Asp/His) box polypeptide 57
  ENST ID: ENST00000620517
  CDS Start-End: 213-1631
gtacttacacaaccccagatggtacaacctacaacacacctaggctgtatgatgtagccaattgctcctagactacaaatctatacagcatgttgctgtactgaatactctaagcaattataacacaatgacctagcaacagtaacataagcaaaggagagtcacgcccaaaatggaaacccaaagccaaagtaccccttcagactctacatatgacttctgagaatcaagagaaagtgaaagctcttctccgagacctgcaagaacaagatgctgatgctggatctgaaagaggcctttctggggaggaggaagatgatgagcctgattgctgtaacgatgagcggtactggccagctggacaggaaccttccctcgttcccgacttggatcctttggaatatgctggcttagcctcagtggagccttatgttccagaatttacagtctccccatttgcagtgcaaaaactttccaggtatggtttcaatactgaacgctgtcaagcggtcctgaggatgtgtgatggagatgtgggagcatcactagagcatctccttacccagtgtttttcagagacatttggagagaggatgaagatctctgaggcagtcaaccagataagcttggatgagtgtatggaacagcgacaggaagaggcatttgctctcaagtccatctgtggagaaaaatttatagaaagaattcagaacagagtctggaccattgggttagaactggagtatctgacaagtagattccgcaaatccaagccaaaagaaagtaccaaaaatgtacaagagaattcacttgaaatctgtaaattttacctcaaaggaaattgtaaatttggatcaaaatgcagattcaaacatgaagtgcccccaaatcaaattgttggaagaatagaaagaagtgtagatgattctcatcttaatgctattgaagatgcatcttttttatatgaacttgaaattcgattttctaaagaccacaaatatccctaccaagctccgctcgtggcattttattccaccaatgagaacctacctctggcttgtcgtttacatatttctgagtttctttatgacaaggccttgacatttgcggaaacttcggaacctgtcgtatattctttgataacccttttagaggaagagtcggaaatagtcaagttactaacgaatacccaccacaagtatagtgaccctcctgtgaactttctgccagtaccctctaggaccagaataaataatcctgcctgtcataaaacagtgattccaaataattcttttgtttctaatcaaattccagaagttgaaaaagcatcagaatctgaggagtcagatgaggatgacggtcctgcacctgttatagtagagaatgaaagctatgtgaaccttaagaaaaagatttccaaaagatatgactggcaggcaaagtcagtacatgctgaaaatggtaaaatctgcaagcagttccgaatgaaacaggcttccagacagttccagtccattctgcaagagaggcaatcactccctgcttgggaagaaagagaaaccattcttaacttattgcgtaagcaccaggtggttgtcataagtggtatgactgggacttatttgttttaatgtacagatgtgggaaaaccacacaaattccgcagtttattctggatgattctctgaatggaccacctgagaaggtagccaacatcatctgtacccaaccccgacgaatctctgcaatctctgttgctgaacgcgttgctaaagaaagagcagagagggtgggtctgaccgtgggataccagattcggttagaaagtgtcaagtcctcagccaccagactgttatactgcaccacgggagtgctgctgagaaggctagaaggagatacagctctacaaggagtttcccatatcattgttgatgaagttcatgagaggacagaagaaagtgacttcttgctgctagttttgaaggacattgtatcgcagaggccaggtcttcaagttattttaatgagtgcaactctaaacgctgagcttttttcagactattttaattcctgccccgttattactataccaggtcgtacatttcctgttgatcaattttttttggaagatgcaattgctgtgacaaggtatgtattacaggatgggagcccatatatgcggtccatgaaacagatttcaaaggaaaagcttaaagcaaggcggaacagaactgcatttgaagaagtggaagaagacctaaggctctcccttcacctccaggatcaggattctgtcaaagatgcagtgccagatcaacagttagattttaagcagctcctggcccgctataaaggggttagcaagtcagtcatcaaaacaatgtccatcatggattttgaaaaggtgaatcttgaattaatagaggccttattagagtggattgtggatggaaagcactcctaccctccaggtgctatacttgtatttttaccaggactagcagaaatcaaaatgctttatgaacagctacagtctaattctcttttcaacaacagacgtagtaatcgatgtgttattcacccacttcattcatctttatccagtgaagagcagcaggctgtgtttgtaaaacctcctgcaggagtaactaagattataatttccaccaacattgctgagacatccataaccatcgatgatgttgtctatgttatcgattctgggaaaatgaaagaaaagagatatgatgccagcaaagggatggaaagtctagaggacacctttgtatctcaagctaatgctctacaaaggaaaggccgagcaggccgtgttgcatctggggtctgcttccatttattcactagccatcactacaatcaccagcttttaaaacaacagctaccagaaatacaaagagtgccattggaacagctgtgtctaagaattaaaattttagagatgtttagtgctcataatctccagtctgtgttctctcggctcattgaacctccacacaccgattctcttcgtgcctcaaaaatacgattacgagacttaggagcattaactccagatgaaagattgacccctcttgggtatcatttggcctctctgcccgtggatgtgagaattggcaaactaatgttgtttgggtctatcttccgctgtttggatcctgctctcaccattgctgccagtttggcttttaagtctccgtttgtatctccctgggataaaaaagaagaagctaaccagaaaaagctggaatttgcattcgcaaacagtgattatctggcccttctacaagcgtataagggatggcagctaagtacaaaagaaggcgtgcgtgcaagttataattactgcagacaaaacttcttgtctggaagagttctgcaggaaatggccagcctcaaacgacaattcacggaactgttatcggatatagggtttgcaagggaagggctcagagcaagggaaattgagaaaagggcccaaggaggagatggtgtcttagatgccacaggagaagaggcaaactcaaatgctgagaaccccaagctgatatcagcaatgctgtgtgctgctttgtatccaaatgtagtgcaggtgaaaagcccagaaggaaaatttcagaagaccagtactggagctgtcagaatgcaaccaaaatcagctgagttgaagtttgtcaccaagaacgatggatatgtacacattcacccttcatcagtgaactatcaggtgagacactttgacagcccctacctgttgtaccacgagaagataaaaactagtcgagtattcatccgagactgcagcatggtgtctgtgtacccgctggtcttgtttggaggaggccaagtgaatgtgcagcttcaaagaggagagttcgttgtctccctggatgatggttggatccgttttgtagctgcttcccatcaggtggctgaactggtaaaggagcttcgttgcgaacttgatcagcttctccaggataaaattaaaaacccaagcattgatctgtgtacgtgtcctcgaggatcccggatcatcagcacaattgtgaaacttgtcaccacacaataaaaagcagtcttagagagtg

SEQ ID NO: 125568 - DNA, 2994 bp, Homo sapiens
  Payload ID: 4615
  Gene Symbol: DHX15
  Gene Name: DEAH (Asp-Glu-Ala-His) box helicase 15
  Uniprot ID: O43143
  ENST ID: ENST00000336812
  CDS Start-End: 158-2545
tcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtagttgtgtcaactaacatagcagagacgtctttgacaatagatggtgtggtgtttgtgattgatcctggatttgcgaaacagaaggtctacaatcctcgaatcagagttgagtcccttttggtgacagctattagtaaagcttcagctcagcaaagggctggtcgagctggacgtaccagacctggaaaatgcttcagactttacacagagaaagcttataaaacagaaatgcaggataacacctatcctgagattttgcgttctaatttaggatcagttgtgttacaattgaagaaacttggtattgatgacttggtacattttgattttatggatccaccagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcagtcccacagtgttttgttcgccccacggaggccaagaaagccgcagatgaggccaagatgagatttgcccacatagatggagatcatctgacactgctgaacgtctaccatgcttttaaacaaaatcatgaatcggttcagtggtgttatgacaacttcattaactacaggtccctgatgtccgcagacaatgtacgccagcagctatctcgaattatggacagatttaatttgcctcgtcgaagtactgactttacaagcagggactattatattaatataagaaaagctttggttactgggtattttatgcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaa

SEQ ID NO: 125569 - DNA, 3994 bp, Homo sapiens
  Payload ID: 4616
  Gene Symbol: DHX30
  Gene Name: DEAH (Asp-Glu-Ala-His) box helicase 30
  ENST ID: ENST00000348968
  CDS Start-End: 421-3921
cggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagcatccctggatgtgaatgaggaccctccttaaacaggaatggagaggttgagctggtcatttccaaccttagcttcaaggcagaactggaattagtttcaaaataaaccttgatcctaggcatttagttctagaagatcctacaagcacgtctgctgtaactctatatcgggcccagcacaggcagcgtcagtgcaaacttcccccaccccgccttccacccatgtgtgtcaaccctaccccaggagggaccatctctcgagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 125570 - DNA, 3887 bp, Homo sapiens
  Payload ID: 4616
  Gene Symbol: DHX30
  Gene Name: DEAH (Asp-Glu-Ala-His) box helicase 30
  ENST ID: ENST00000395745
  CDS Start-End: 202-330
agttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtg

SEQ ID NO: 125571 - DNA, 3660 bp, Homo sapiens
  Payload ID: 4616
  Gene Symbol: DHX30
  Gene Name: DEAH (Asp-Glu-Ala-His) box helicase 30
  Uniprot ID: Q7L2E3
  ENST ID: ENST00000446256
  CDS Start-End: 1-3585
atgttcagcctggactcattcagaaaagatcgggcccagcacaggcagcgtcagtgcaaacttcccccaccccgccttccacccatgtgtgtcaaccctaccccaggagggaccatctctcgagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtgacc

SEQ ID NO: 125572 - DNA, 3748 bp, Homo sapiens
  Payload ID: 4616
  Gene Symbol: DHX30
  Gene Name: DEAH (Asp-Glu-Ala-His) box helicase 30
  Uniprot ID: Q7L2E3
  ENST ID: ENST00000457607
  CDS Start-End: 13-3681
ggcgggagcacgatggcggccgctaggagactcatggcgctggccgccggcatctctccgcgcctgcagccgctgggtccccgcgctgctgggcgacagggtcgctcgcgcggcttctcttcaagctgcgcccaccccgaccacaccaaggaagccgccgaggccgagtcagggatggcccccggcgggcctggggaaggcgacggaagcttggtgaacgcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatccc

SEQ ID NO: 125573 - DNA, 613 bp, Homo sapiens
  Payload ID: 4616
  Gene Symbol: DHX30
  Gene Name: DEAH (Asp-Glu-Ala-His) box helicase 30
  ENST ID: ENST00000415400
  CDS Start-End: 229-357
ggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcaggcaggggtctggatttggtctgcaggctgtagttttccaactcctgctctagaccagtgaggagaagaacacagaagcagaagagttccaagagctgctgtaaagagttgcccttatcttacaagagtcattgagcctcattccatcttcctgccttccatccacacgactgctggtttagatttgctggagagtgagctctgcagggtcctagccctgggcagcgccgagc

SEQ ID NO: 125574 - DNA, 4065 bp, Homo sapiens
  Payload ID: 4616
  Gene Symbol: DHX30
  Gene Name: DEAH (Asp-Glu-Ala-His) box helicase 30
  Uniprot ID: Q7L2E3
  ENST ID: ENST00000445061
  CDS Start-End: 408-3992
gccccattgggccgggtgctggggcatcccgggcgctgggtgccccgagcggctacgacgagtcccaggtggggccgggctccaggcccgcgggggagcggagccgtgcgccgcaggcgggctccgtgacgccgggtggggaacgccgggccggtggcgggacttccgccacgggactcggaaggggccgcgccgccgctgctgggagttgtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtga

SEQ ID NO: 125575 - DNA, 1957 bp, Homo sapiens
  Payload ID: 4616
  Gene Symbol: DHX30
  Gene Name: DEAH (Asp-Glu-Ala-His) box helicase 30
  ENST ID: ENST00000441384
  CDS Start-End: 198-326
gtagtccggccgtggttgggggagccgcggctcatgcgcggtgcacagaggcttgtttcacatctgtaacaacaggaggaggcccagcctcgtgatgaggaatagcaaggagagaattcagctccagttcaaaagcctacaaaatctgagactgtcattgcttttataaggattccagctttccctcctggccagaaatgttcagcctggactcattcagaaaagatcgggcccagcacaggcagcgtcagtgcaaacttcccccaccccgccttccacccatgtgtgtcaaccctaccccaggagggaccatctctcgaggctgaacgttaacatttccaacatggcagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaaggtgagttgggtctcctagaagtttgtgtgggggccgtttacttggtcatgtctggtgttccctaaaggcaggtttagagagggctgagggggtgtgttcctccagcccaaacctaggccaggtggaggaactcctgcttgggaggaaaagcagcaggtgtgatggaatggaggtcaagcctcagcagcacagggagtgggcttgggggccgcaagagcagaagacccatacctcttctgggcggtggattgtcagtggggaagggttagaggtgtgggtcttggtgaggtatgaatttctctcttgctgccaggcgaaggggctttggtcatgaaatgcctaaccttgtttttactttaactcgttgctttgaattttgtcctgcttgtctctttaatcacctagccttgcttctcatgtaaaataagactctctctagctaagaaagccgtacaaaccccaattgaccccttaatttacaagacactaagggctcctcacccaaccccctttcgtaaggagttggcctgggtaaacagatcctcagcatttcaaaggagcctaattaactgataaggtacgaacaccaacaatatatgaagttcccaggaattttctccaagagataacaacataaaaccttgagttcgtgtctggcgtagaccctatatctaattataatgaaagatttagaatcttgcacctggtactgttgctcttcttgtaaccatttgtcttttaagttgtttatcactctgtaaccattttgattcttttgattcttgcatgtttttacttctgtagaattattacatttaagtccccctccccttcctaaacctaagtataaaagttaatcgagccccttcctcgtggccgaaagaattttgagcattagctgtctctttggccgccggcttaataaaggactcttaattcgtc

SEQ ID NO: 125576 - DNA, 3574 bp, Homo sapiens
  Payload ID: 4616
  Gene Symbol: DHX30
  Gene Name: DEAH (Asp-Glu-Ala-His) box helicase 30
  Uniprot ID: Q7L2E3
  ENST ID: ENST00000619982
  CDS Start-End: 32-3499
ctcgaaaaggctgaacgttaacatttccaacatggcagcttctagggacctattaaaagagttcccacagcccaaaaatcttctcaacagtgtgattggaagagccctcggcatctcacatgcaaaagacaaactagtctacgtgcacacaaatggaccgaagaaaaagaaagtcacactgcacataaaatggcccaagagcgtggaggtagaaggctatggcagcaagaagatcgatgctgagcggcaggctgcagctgcagcctgccagctgttcaagggttggggtctgctaggtccccggaatgagttgtttgacgcagccaaataccgagtgctagctgatcgctttggctcccctgccgacagctggtggcgtccggaacccaccatgccccctacttcctggcggcagctgaatccagagagtattcgaccagggggacctgggggcctatcccgctctttaggccgggaagaagaggaggacgaggaggaagagctagaagaagggaccatagatgttaccgacttcttgtccatgacccagcaggattcccacgctccactcagggactcaagggggagttcctttgagatgacagatgacgacagtgccattagggctctgacccagtttccacttcccaagaaccttctggccaaggtgattcagattgcaacgtcatcctccacagctaagaacctcatgcagttccatactgtgggcaccaagaccaagctgtctacactcaccctgctctggccctgccccatgacctttgttgccaaagggcgccgcaaagcagaggctgagaataaggcggcagccttggcctgcaagaaactgaagagcctgggcctggtggacaggaacaacgaaccgcttacacacgccatgtataacctggcctctttgcgtgagctgggtgagacccagcgccgaccatgcaccatccaggtgcccgagcccatcctccgcaagatagagaccttcctgaaccattaccctgtggagagttcatggatcgccccagaactccggctgcagagtgatgacatcttgcccttgggcaaggactcagggcctctgagtgaccctatcacaggcaagccctatgtgcccctgttggaagcagaggaggtacgtctcagccagagtctgctagaactgtggcggcggcgagggccggtctggcaggaggccccccagctacctgtggacccacatcgggacaccatcctcaacgccattgagcagcacccggtggtggtcatctctggggacacgggctgtgggaagaccacgcgcatcccccagctgttgctggagcgctatgtgaccgagggccgaggtgcccgctgcaatgttatcatcacccaacctcgccgcatctctgctgtgtctgtggcacagcgggtcagccacgaactgggcccctccctgcgccggaatgtgggcttccaggtgcggttggaaagtaagcccccatcccgaggcggggccctgctcttctgcactgtgggtatcctgctgcgtaagctgcagagcaaccccagcctggagggcgtgagccacgtcatcgtggatgaggtgcatgagcgggacgtgaacacagactttctgctgatcctgctcaagggcctgcagcggctcaacccggccctgcggctggtgctcatgagtgccacaggggacaatgagcgcttctcccgatactttggtggctgccccgtcatcaaggtgcctggcttcatgtacccagtcaaggagcactacctagaggacatcctggccaagttgggcaagcaccagtacctgcaccggcaccggcaccatgagtctgaggatgaatgcgcactcgatttggaccttgtgactgatctggttctgcacatcgatgctcgcggggaaccaggtgggatcctgtgcttcctgcctgggtggcaggagatcaaaggagtgcagcagcgcctccaggaggccctgggcatgcacgagagcaagtacctcatcctgccagtgcactccaacatccccatgatggatcagaaggccatattccagcagcctccagttggggtgcgcaagattgtcttggccaccaacattgctgagacttccatcacaatcaatgacatcgtgcatgtggtggacagtgggctgcacaaggaagaacgctatgacctgaagaccaaggtgtcctgcctggagacagtgtgggtatcaagagccaatgtgatccagcgccggggccgggcgggccgctgccagtccggctttgcctaccacttgttccctcgaagccggctggagaaaatggtccctttccaagtgccagagatcctgcgcacacctcttgagaacctggtgctgcaagcgaaaatccacatgcctgagaagacggcggtggagttcctgtccaaggctgtggacagtccaaacatcaaggcagtggacgaggctgtgatcttgctccaggagatcggggtgctggaccagcgggagtacctgactaccctggggcagcgcctggctcacatctccaccgacccccggttggccaaggccattgtgttggctgccatcttccgttgcctgcacccactactggtggtcgtttcctgcctcacccgggaccccttcagcagcagcctacagaaccgggcagaggtggacaaggtgaaagcactgttgagccatgacagcggcagtgaccacctggcctttgtgcgggctgtcgccggctgggaggaggtgctgcgttggcaggaccgcagctcccgggagaattacctggaggaaaacctgctgtacgcacccagcctgcgcttcatccacggactcatcaagcagttctcagagaacatttatgaggccttcctggtggggaagccctcggactgcaccctggcctccgcccagtgcaacgagtacagtgaggaggaggagctggtgaagggcgtgctgatggccggcctctaccccaacctcatccaggtgaggcagggcaaggtcacccggcaggggaagttcaagcccaacagcgtcacatataggaccaaatcaggcaacatcctgctgcacaagtcgaccattaacagggaggccacacggttacggagccgatggctgacgtatttcatggcagtcaagtccaatggcagcgtcttcgtccgggactcctctcaggtgcacccgctagctgtgctgctgctgaccgacggggacgtgcacatccgtgatgacgggcgccgggccaccatctcactgagcgacagtgacctgctgcggctggagggtgactcgcgtaccgtgcggctgctgaaggagctgcggcgggccctgggccgcatggtggagcggagcctgcgcagcgagctggctgcacttccccccagcgtacaggaggagcacgggcagctgcttgcgctactggcagagctgctgcgaggaccctgtggcagctttgatgtgcgcaagacagctgacgactgagccctgcttctgctggggctgtgtacagagtgcaaatgtttatttaaaataaagttctatttatcccttgtgacc

SEQ ID NO: 125577 - DNA, 4240 bp, Homo sapiens
  Payload ID: 4617
  Gene Symbol: DHX9
  Gene Name: DEAH (Asp-Glu-Ala-His) box helicase 9
  Uniprot ID: Q08211
  ENST ID: ENST00000367549
  CDS Start-End: 111-3923
gcgagttgctgtgcgtttctctgttgtctcggtagaaggccagagtcacacacggtcctaagagctgggcaccaggaagcgaaggctgatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggttcaggtggaaggttataattacactggcatgggaaattccaccaataaaaaagatgcacaaagcaatgctgccagagactttgttaactatttggttcgaataaatgaaataaagagtgaagaagttccagcttttggggtagcatctccgcccccacttactgatactcctgacactacagcaaatgctgaaggagatttaccaacaaccatgggaggacctcttcctccacatctggctctcaaagcagaaaataattctgaggtaggggcctctggctatggtgttcctgggcccacctgggaccgaggagccaacttgaaggattactactcaagaaaggaagaacaagaagtgcaagcgactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggagctttattgcagaaatgaccatttatatcaagcagctgggcagaaggatttttgcacgagaacatggatcaaataagaaattggcagcacagtcctgtgccctgtcacttgtcagacaactgtaccatcttggagtggttgaagcttactccggacttacaaagaagaaggaaggagagacagtggagccttacaaagtaaacctctctcaagatttagagcatcagctgcaaaacatcattcaagagctaaatcttgagattttgcccccgcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgctactccagagcaaataagcatggacctcaagaatgaattgatgtaccagttggaacaggatcatgatttgcaagcaatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcagcccagaagaatcagtgcggtttctgtggcagagcgagttgcatttgaaagaggagaagagcctggaaaaagctgtggctacagcgttcgatttgagtctatacttcctcgtcctcatgccagtataatgttttgtactgtaggtgtgctcctgagaaaattagaagcaggcattcgaggaatcagtcatgtaattgtagatgaaatacatgaaagagatattaatactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaagaatattttctggaagactgcattcagatgacccactttgttcctccaccaaaagacaaaaagaagaaggataaggatgatgatggtggtgaggatgatgatgcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggaagccatcggtatcagattctacccctgcattctcagattcctcgagaggaacagcgcaaagtgtttgatccagtaccagttggagtaaccaaggttattttgtccacaaatattgctgaaacaagcattaccataaacgatgttgtttatgtcattgactcctgcaagcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagagagcttgatgcattagatgccaatgatgagttgactcctttgggacgaatcctggctaaactccccattgagcctcgttttggcaaaatgatgataatggggtgtattttctacgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctagaatgggtggagaagaagcagagatacgtttttgtgagcacaaaagacttaatatggctacactaagaatgacttgggaagccaaagttcagctcaaagagattttgattaattctgggtttccagaagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaagattcgaactcgagccatctctgctaaaggcatgactttagtcacccccctgcagttgcttctctttgcctccaagaaagtccaatctgatgggcagattgtgcttgtagatgactggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaata

SEQ ID NO: 125578 - DNA, 1933 bp, Homo sapiens
  Payload ID: 4618
  Gene Symbol: DHX16
  Gene Name: DEAH (Asp-Glu-Ala-His) box polypeptide 16
  ENST ID: ENST00000376437
  CDS Start-End: 128-1810
ctgaacaatatgtgcctttttgactcttcagaggctgtgaatttctggtcttggaagatcacagtggagcaattggacagataggattttatccttcatatcccttgcaaaagatctctaagaacccatggagagccagccagcgcaagagtgtctgatgcagatgtttttgcccatcgagccagcctgctttgtggaatggctggggacttcaccatcacagttaggcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtga

SEQ ID NO: 125579 - DNA, 3445 bp, Homo sapiens
  Payload ID: 4618
  Gene Symbol: DHX16
  Gene Name: DEAH (Asp-Glu-Ala-His) box polypeptide 16
  Uniprot ID: O60231
  ENST ID: ENST00000376442
  CDS Start-End: 197-3322
ggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtga

SEQ ID NO: 125580 - DNA, 1933 bp, Homo sapiens
  Payload ID: 4618
  Gene Symbol: DHX16
  Gene Name: DEAH (Asp-Glu-Ala-His) box polypeptide 16
  ENST ID: ENST00000383576
  CDS Start-End: 128-1810
ctgaacaatatgtgcctttttgactcttcagaggctgtgaatttctggtcttggaagatcacagtggagcaattggacagataggattttatccttcatatcccttgcaaaagatctctaagaacccatggagagccagccagcgcaagagtgtctgatgcagatgtttttgcccatcgagccagcctgctttgtggaatggctggggacttcaccatcacagttaggcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatggcgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtga

SEQ ID NO: 125581 - DNA, 3445 bp, Homo sapiens
  Payload ID: 4618
  Gene Symbol: DHX16
  Gene Name: DEAH (Asp-Glu-Ala-His) box polypeptide 16
  Uniprot ID: O60231
  ENST ID: ENST00000383577
  CDS Start-End: 197-3322
ggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatggcgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaaggtggttgtggcaacgaacattgctgagacatcactcaccattgagggcatcatttatgtgctggatccagggttctgtaagcagaagagctacaacccccgcacaggcatggaatcgctcactgtcacaccctgcagcaaggcctcagccaatcagcgagctggcagggcaggtcgggtggctgcagggaagtgcttccgcctgtataccgcctgggcctatcagcacgagcttgaggaaaccacagtgcctgagatccagaggaccagcttgggcaatgtcgtgttgctgctcaagagcttagggatccatgacctaatgcactttgatttcctggaccctccaccatatgagacactgctgctggctttggagcagctgtatgctctgggagccctcaaccaccttggggagctcaccacgtctggtcgaaagatggcagagctgccggtggaccccatgctgtccaaaatgatcttagcctctgagaagtacagctgttcagaggagatcctgacagtggctgccatgctctctgtcaacaactccatcttctaccgaccaaaggacaaggtcgtccatgctgacaatgcccgtgtcaacttctttctccctggcggtgaccacctggttctgctaaatgtttacacacagtgggctgagagtggttactcttcccagtggtgctatgagaactttgtacagttcagatcgatgcgccgagcccgggatgtgcgggaacagctggaagggctcttggaacgtgtggaagttggtctcagttcctgccagggggactatatccgtgtacgcaaggccatcactgctggttacttttaccacacggcacggttgactcggagtggctaccgcacagtgaaacagcagcagacagtcttcattcatcccaactcctccctctttgagcaacagccacgctggctgctctaccacgaacttgtcttgaccaccaaagagttcatgagacaggtactggagattgagagcagttggcttctggaggtggctccccattattataaggccaaggagctagaagatccccatgctaagaaaatgcccaaaaaaataggcaaaacacgagaagagctagggtaagagaaggacgtaaacagaacctgacaccagctccttttccttctatacattatttaatacctattaaataaaattatttttggaataaagcttgtgggaacatttgggatctagagaaagtga

SEQ ID NO: 125582 - DNA, 3445 bp, Homo sapiens; identical to SEQ ID NO: 125579
  Payload ID: 4618
  Gene Symbol: DHX16
  Gene Name: DEAH (Asp-Glu-Ala-His) box polypeptide 16
  Uniprot ID: O60231
  ENST ID: ENST00000424672
  CDS Start-End: 197-3322

SEQ ID NO: 125583 - DNA, 892 bp, Homo sapiens
  Payload ID: 4618
  Gene Symbol: DHX16
  Gene Name: DEAH (Asp-Glu-Ala-His) box polypeptide 16
  ENST ID: ENST00000447945
  CDS Start-End: 7-892
tttgggatgtcggaagatcctagaggtcccaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactgg

SEQ ID NO: 125584 - DNA, 3445 bp, Homo sapiens; identical to SEQ ID NO: 125579
  Payload ID: 4618
  Gene Symbol: DHX16
  Gene Name: DEAH (Asp-Glu-Ala-His) box polypeptide 16
  Uniprot ID: O60231
  ENST ID: ENST00000417308
  CDS Start-End: 197-3322

SEQ ID NO: 125585 - DNA, 2203 bp, Homo sapiens
  Payload ID: 4618
  Gene Symbol: DHX16
  Gene Name: DEAH (Asp-Glu-Ala-His) box polypeptide 16
  ENST ID: ENST00000450902
  CDS Start-End: 197-2203
ggccgaaaaagtacagccccttccgggctccgcggtacgggaagacagctttgggatgtcggaagatcctagaggtcccaaggtagctgacttgcgaagctgaggctccagccgagggctccaggcctctgaccggcccagcagtgagcgcggctgcccgacgcttcagggccgggagcagggagcgtgagtcgccatggcgacgccggcgggtctggagcgctgggttcaggacgagctgcactcggtgttggggctgagcgagcggcacgtcgcccagtttctgatcggtaccgcacagcgctgcacctctgccgaggagttcgtgcagcgcctacgagacactgataccttggatctcagtgggccggcccgggacttcgccctgagactctggaacaaggtaccacgaaaggcagtggtagaaaagccagctcgggcagcagagcgagaggcccgggccctgctggagaagaaccgatcttataggttactggaagacagtgaagagagcagtgaggagactgtgagtagggctggaagcagcctccagaagaaacgtaaaaagcggaaacacctcaggaagaagcgtgaggaagaagaggaggaagaggcttctgagaaagggaagaagaaaacaggggggagtaaacagcagacagagaagccagagtcggaagatgagtgggaacggacagagcgtgaacgccttcaggacctggaggagcgtgatgcctttgctgagcgggttcgacagcgggacaaggatcggactcgaaatgtcctggaacggtcagacaagaaggcttatgaagaggctcagaagcgcctcaagatggccgaggaagaccggaaggccatggtccctgagctgcggaagaaatctcgccgagagtacctggctaagcgggagcgagagaagcttgaggacctggaggcggagctggctgatgaggagttcctttttggggacgtggagctgagccggcacgagcggcaggagctcaaatataagcggcgagtgcgggatctcgcccgggagtaccgggcagctggggagcaggagaagctggaggccaccaatcgctaccacatgcccaaggaaacccgaggacagccagcccgagctgtggatctagtggaggaggaatcaggagcccctggggaggagcagcggcgctgggaggaggcgcggcttggggcagcgtccctgaagtttggggcccgagatgctgcctctcaggagcccaagtatcaactggtgctggaggaggaggagaccattgagtttgtccgggccactcagctccagggtgatgaggagccgtcagctccacccacttcaactcaggcccagcagaaagagtccatccaggccgtccgccgcagcctcccggtgttcccatttcgagaggagctcctggctgctattgcaaatcaccaagtcctcatcattgaaggcgagacaggctcagggaagaccacccagatcccgcagtatctctttgaggagggttatacaaacaagggtatgaagattgcctgcacccaaccccggagagtggctgccatgagtgtggccgcccgagtggcccgggagatgggtgtgaagcttgggaatgaggttggctacagcatccgctttgaggactgcacatcagagcgaactgtcctccgctacatgacagatgggatgcttctccgggagttcctctctgagcctgacctggcgagttacagcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaag

SEQ ID NO: 125586 - DNA, 892 bp, Homo sapiens; identical to SEQ ID NO: 125583
  Payload ID: 4618
  Gene Symbol: DHX16
  Gene Name: DEAH (Asp-Glu-Ala-His) box polypeptide 16
  ENST ID: ENST00000450691
  CDS Start-End: 7-892

SEQ ID NO: 125587 - DNA, 3445 bp, Homo sapiens; identical to SEQ ID NO: 125579
  Payload ID: 4618
  Gene Symbol: DHX16
  Gene Name: DEAH (Asp-Glu-Ala-His) box polypeptide 16
  Uniprot ID: O60231
  ENST ID: ENST00000458094
  CDS Start-End: 197-3322

SEQ ID NO: 125588 - DNA, 3445 bp, Homo sapiens; identical to SEQ ID NO: 125579
  Payload ID: 4618
  Gene Symbol: DHX16
  Gene Name: DEAH (Asp-Glu-Ala-His) box polypeptide 16
  Uniprot ID: O60231
  ENST ID: ENST00000421095
  CDS Start-End: 197-3322

SEQ ID NO: 125589 - DNA, 892 bp, Homo sapiens; identical to SEQ ID NO: 125583
  Payload ID: 4618
  Gene Symbol: DHX16
  Gene Name: DEAH (Asp-Glu-Ala-His) box polypeptide 16
  ENST ID: ENST00000415603
  CDS Start-End: 7-892

SEQ ID NO: 125590 - DNA, 892 bp, Homo sapiens; identical to SEQ ID NO: 125583
  Payload ID: 4618
  Gene Symbol: DHX16
  Gene Name: DEAH (Asp-Glu-Ala-His) box polypeptide 16
  ENST ID: ENST00000448766
  CDS Start-End: 7-892

SEQ ID NO: 125591 - DNA, 1933 bp, Homo sapiens; identical to SEQ ID NO: 125578
  Payload ID: 4618
  Gene Symbol: DHX16
  Gene Name: DEAH (Asp-Glu-Ala-His) box polypeptide 16
  ENST ID: ENST00000453879
  CDS Start-End: 128-1810

SEQ ID NO: 125592 - DNA, 1933 bp, Homo sapiens; identical to SEQ ID NO: 125578
  Payload ID: 4618
  Gene Symbol: DHX16
  Gene Name: DEAH (Asp-Glu-Ala-His) box polypeptide 16
  ENST ID: ENST00000414052
  CDS Start-End: 128-1810

SEQ ID NO: 125593 - DNA, 3445 bp, Homo sapiens; identical to SEQ ID NO: 125579
  Payload ID: 4618
  Gene Symbol: DHX16
  Gene Name: DEAH (Asp-Glu-Ala-His) box polypeptide 16
  Uniprot ID: O60231
  ENST ID: ENST00000451456
  CDS Start-End: 197-3322

SEQ ID NO: 125594 - DNA, 1933 bp, Homo sapiens; identical to SEQ ID NO: 125578
  Payload ID: 4618
  Gene Symbol: DHX16
  Gene Name: DEAH (Asp-Glu-Ala-His) box polypeptide 16
  ENST ID: ENST00000445379
  CDS Start-End: 128-1810

SEQ ID NO: 125595 - DNA, 1933 bp, Homo sapiens; identical to SEQ ID NO: 125578
  Payload ID: 4618
  Gene Symbol: DHX16
  Gene Name: DEAH (Asp-Glu-Ala-His) box polypeptide 16
  ENST ID: ENST00000451748
  CDS Start-End: 128-1810

SEQ ID NO: 125596 - DNA, 1933 bp, Homo sapiens; identical to SEQ ID NO: 125578
  Payload ID: 4618
  Gene Symbol: DHX16
  Gene Name: DEAH (Asp-Glu-Ala-His) box polypeptide 16
  ENST ID: ENST00000449861
  CDS Start-End: 128-1810

SEQ ID NO: 125597 - DNA, 892 bp, Homo sapiens; identical to SEQ ID NO: 125583
  Payload ID: 4618
  Gene Symbol: DHX16
  Gene Name: DEAH (Asp-Glu-Ala-His) box polypeptide 16
  ENST ID: ENST00000449252
  CDS Start-End: 7-892

SEQ ID NO: 125598 - DNA, 892 bp, Homo sapiens; identical to SEQ ID NO: 125583
  Payload ID: 4618
  Gene Symbol: DHX16
  Gene Name: DEAH (Asp-Glu-Ala-His) box polypeptide 16
  ENST ID: ENST00000427297
  CDS Start-End: 7-892

SEQ ID NO: 125599 - DNA, 691 bp, Homo sapiens
  Payload ID: 4618
  Gene Symbol: DHX16
  Gene Name: DEAH (Asp-Glu-Ala-His) box polypeptide 16
  ENST ID: ENST00000456005
  CDS Start-End: 128-691
ctgaacaatatgtgcctttttgactcttcagaggctgtgaatttctggtcttggaagatcacagtggagcaattggacagataggattttatccttcatatcccttgcaaaagatctctaagaacccatggagagccagccagcgcaagagtgtctgatgcagatgtttttgcccatcgagccagcctgctttgtggaatggctggggacttcaccatcacagttaggcgtggtgatggtggatgaggcacacgaaaggaccctacacacagacattctctttggattgatcaaggatgttgctcgcttccgacctgagctcaaggtcctggtggcttcagccacaatggacactgcccgtttttccaccttctttgatgacgcccctgtgtttcgaatccccggacgcaggtttcctgtggacatcttctacaccaaggctccagaggctgactacttggaagcttgtgtagtatctgtgttgcagatccatgtgacccagccccctggggatatcctggtgttcctgacaggacaggaggagattgaggctgcctgtgagatgctccaggatcgctgccgccgcctgggctccaaaatccgggagctcctggtgctgcccatttatgccaatctgccctctgacatgcaggcccgtatcttccagcccacaccacctggggcacgaaag

SEQ ID NO: 125600 - DNA, 892 bp, Homo sapiens; identical to SEQ ID NO: 125583
  Payload ID: 4618
  Gene Symbol: DHX16
  Gene Name: DEAH (Asp-Glu-Ala-His) box polypeptide 16
  ENST ID: ENST00000436662
  CDS Start-End: 7-892

SEQ ID NO: 125601 - DNA, 892 bp, Homo sapiens; identical to SEQ ID NO: 125583
  Payload ID: 4618
  Gene Symbol: DHX16
  Gene Name: DEAH (Asp-Glu-Ala-His) box polypeptide 16
  ENST ID: ENST00000446074
  CDS Start-End: 7-892

SEQ ID NO: 125602 - DNA, 4502 bp, Homo sapiens
  Payload ID: 4619
  Gene Symbol: DHX29
  Gene Name: DEAH (Asp-Glu-Ala-His) box polypeptide 29
  Uniprot ID: Q7Z478
  ENST ID: ENST00000251636
  CDS Start-End: 150-4259
aattgcgaggcagcggtcgccccggcccgagaagcccggatcgaagcgcagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaagataaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtagggttagggtaatcaagtctgaagatgatgtcctggtagtatgccctacaatcttaacagaagatggcatgcaagctcagcacctgggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataactgaaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgca

SEQ ID NO: 125603 - DNA, 479 bp, Homo sapiens
  Payload ID: 4619
  Gene Symbol: DHX29
  Gene Name: DEAH (Asp-Glu-Ala-His) box polypeptide 29
  ENST ID: ENST00000508346
  CDS Start-End: 1-479
gcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatac

SEQ ID NO: 125604 - DNA, 4450 bp, Homo sapiens
  Payload ID: 4619
  Gene Symbol: DHX29
  Gene Name: DEAH (Asp-Glu-Ala-His) box polypeptide 29
  ENST ID: ENST00000621106
  CDS Start-End: 102-4214
cagggtggcagccccggagccggggaatgtgaagagctctcggctgtgcagtggtaccgtcggggcctgggccgcgaaggatcttctgccacagctgcaacatgggcggcaagaacaagaaacacaaggctccagcggccgcggtggtccgggccgccgtgtctgcttccagagccaaatctgccgaggctggaattgccggggaggcccaaagcaagaagccagtgtccaggccggccaccgctgccgctgccgctgccggctccagggagccccgtgtcaagcaaggtccaaaaatttatagttttaattctacaaatgattctagtggtcctgcaaatctggataaatctattttgaaagtggtaattaataacaaactagagcaaagaattattggagtgatcaatgagcataaaaagcaaaataatgacaaaggaatgatttctggaagacttactgccaaaaaattgcaggatttatacatggctttacaagcattttcatttaagacaaaggacattgaagatgccatgaccaatacactcttatatggaggtgaccttcattctgccttggattggctctgtttaaacctttcagatgatgcacttcctgaaggattcagtcaggaatttgaagagcagcaacctaaaagtaggcctaaatttcagtctcctcaaatacaagccactatttcacctccattgcaacctaaaacaaaaacatatgaagaggaccctaagagtaagccaaaaaaggaagaaaaaaatatggaagtaaatatgaaagagtggattttacgatatgctgaacaacaaaatgaagaagaaaagaatgagaattctaaaagtttagaagaggaggaaaaatttgaccctaatgaaaggtacttacatcttgcagcaaaactgctggatgcaaaagaacaagcagctacctttaaactagaaaaaaacaagcaaggccaaaaagaggctcaggaaaaaataaggaaatttcaaagagaaatggaaactttagaagaccatccagtatttaacccagccatgaagatttcacatcaacaaaatgaaaggaaaaagcctcctgtagccacagaaggagaaagtgcattgaattttaatttatttgaaaaatctgcagctgctactgaagaagagaaaggtaaaaagaaagaacctcatgatgtaagaaattttgactatactgctcgaagttggactggaaaatctcccaaacaatttctgattgattgggtcaggaagaatcttcccaagagtccaaatccttcctttgaaaaagttccagtaggtagatactggaaatgtagggttagggtaatcaagtctgaagatgatgtcctggtagtatgccctacaatcttaacagaagatggcatgcaagctcagcacctgggagctactttagccctttaccgtttagttaaagggcagtcagttcatcagttacttcctcccacttaccgagatgtttggctggagtggagtgatgcagaaaagaaaagggaagaattaaataaaatggaaaccaataaaccacgtgatctttttattgccaaacttctgaataaactgaaacagcagcaacagcagcaacaacagcattctgaaaataagagagaaaactctgaagatcccgaggaatcttgggaaaatttagtttcggatgaggatttttctgcactgtccttggaatcagcaaatgtggaagatttggaacctgttagaaacctctttagaaagttgcaaagcacacctaagtatcagaaacttctaaaggaaagacaacagctacctgtatttaaacatcgggactcaattgttgaaactcttaaaaggcatcgggtagtggttgtggcaggtgaaacagggagtggtaaaagtactcaggtaccacattttctattggaagatttgcttctaaatgagtgggaagcaagtaaatgtaacattgtctgtacccaaccccgaagaatctcagcagttagtttagccaacagagtatgtgatgaattgggctgtgaaaatggacctggaggaaggaattccttgtgtggatatcagatccggatggaatctcgagcttgtgaatctaccaggttactctattgtacaacaggggttttgctaaggaaacttcaagaagatggtcttctaagtaatgtgtctcatgttattgtagatgaggttcatgaaagaagtgtccagtcagacttcctactaattatcttgaaggaaattttacagaaacgttctgatctacacttgattctaatgagtgccactgtggacagcgaaaaattttctacatatttcacacactgccccattctcagaatttcaggaagaagttatcctgttgaggtttttcatcttgaagatataatagaagaaacaggctttgtactggaaaaagactcagaatattgtcagaaatttctggaagaggaagaagaagtaaccattaatgttacaagcaaagcagggggaataaaaaaatatcaggaatacatcccagttcagactggagcacatgctgatttaaatccattttaccaaaagtacagcagccgcactcagcatgctattctatacatgaatcctcataaaatcaacctggatctcattttggaacttcttgcatacttagataaaagtccccaattcagaaatattgaaggagcagtattgatctttttaccaggacttgctcatattcagcagttgtatgatcttctatcaaatgatagaagattttattctgaacgatataaagtgatagctctgcattctattctttcaacccaagatcaagctgcagcattcacacttccccctccaggagtcaggaagattgttttagcaaccaatattgcagagacgggtatcactattcctgatgttgtatttgtaattgatactggaagaacaaaagaaaataagtaccatgaaagcagtcagatgagttctttggtggagacgtttgtcagtaaagccagtgctttgcagcgccagggaagagctgggcgggtcagagatggcttctgtttccgaatgtacacaagagaaagatttgaaggctttatggattattctgttcctgaaatcttacgtgtacctttggaggaattatgccttcatattatgaaatgtaatcttggttctcctgaagatttcctctccaaagccttagatcctcctcagctccaagtgatcagcaatgcaatgaatttgctccgaaaaattggagcttgtgaattaaatgagcctaaactgactccgttgggccaacaccttgcagctttacctgtgaatgtcaagattggcaagatgcttatttttggtgccatatttggctgccttgacccagtggcaacactagctgcagttatgacagagaagtctccttttaccacaccaattggtcgaaaagatgaagcagatcttgcaaaatcagctttggccatggcggattcagaccacctgacgatctacaatgcatatctaggatggaagaaagcacgacaagaaggaggttatcgttctgaaatcacatactgccggaggaactttcttaatagaacatcactgttaaccctagaggatgtaaagcaggagttaataaagttggttaaggcagcaggattttcatcttccacaacttctaccagctgggaaggaaacagagcctcacagaccctctcattccaagaaattgcccttcttaaagctgtactggtggctggactgtatgacaatgtggggaagataatctatacaaagtcagtggatgttacagaaaaattggcttgcattgtggagacggcccaaggcaaagcacaagtacacccatcctcagtaaatcgagatttgcaaactcatggatggctcttataccaggagaagataaggtatgccagagtgtatttgagagaaactaccctaataaccccttttccagttttactttttggtggtgatatagaagttcagcaccgagaacgtcttctttctattgatggctggatctattttcaggcccctgtaaagatagctgtcattttcaagcagctgagagttctcattgattcagttttaagaaaaaagcttgaaaatccaaagatgtcccttgaaaatgacaagattctgcagatcattacggaattgataaaaacagagaataacaactgaaattcatggtcaactgctttaaaaattaagatgaagatacagtcatgaaattatctgaaaatgggtcatcacattaagtatttcattacttaaaatgttggtactagccattaacttaaaggtggtgggaaaaaagcacatactttaaacatgtataattttctagttcctttttaatgatgattattctgaatgtatttgccactacatttacaataaattctttggtattatgc

SEQ ID NO: 125605 - DNA, 3070 bp, Homo sapiens
  Payload ID: 4620
  Gene Symbol: DHX32
  Gene Name: DEAH (Asp-Glu-Ala-His) box polypeptide 32
  Uniprot ID: Q7L7V1
  ENST ID: ENST00000284690
  CDS Start-End: 492-2723
aggcagagagcacgaggcccagtgcagaatcattttctgaaccagccaggaaataccggaacccaccaaactttaaacaccagcctaaattattcctgttcttttaagcaggcagcagaaatgacagaaacccgttaacagaaaaaaaaaaaataatgcttttcatttgaactcctgtgcattttctttttaacttatatgtgttcctaattttccttactctttttgtttgtttgtttcttagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaagctcataattaactcctcacctcacctgatcagcaaactcaattcttattatggaaacgtgcctgtcatagaagtgaaaaataaacaccctgtggaggttgtgtaccttagtgaggctcaaaaggattcttttgagtctattttacgccttatctttgaaattcaccactcgggtgagaaaggtgacattgtagtctttctggcctgtgaacaagatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcagccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattactactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagt

SEQ ID NO: 125606 - DNA, 2389 bp, Homo sapiens
  Payload ID: 4620
  Gene Symbol: DHX32
  Gene Name: DEAH (Asp-Glu-Ala-His) box polypeptide 32
  ENST ID: ENST00000368721
  CDS Start-End: 936-2039
gttctcattattccaattggcaagttttcactcattaggatcaacagccatgctgtttgcttggtaaaaaatctgccccaagtaattcaattatatgtggaaaaaggaagtgcaagcaagggaccgtacctgtgtaccagctgatgtgggaccccctggagcggcctctgcccagcttcctgggagccacttagcagaccaggaaacgagcacagctcacctagttctcagtgacctgtgataccttgctatttttctagatggatctgtcttcctacaaaacccttgagttaattcaatcccattctacaaatggtatggaaaggaaagagacataagctagagacctagagaatggaattgagctgtaaaaactatggcagttgtgggaagtcatcttttttacttagatttttagtgaaatctaacaaaattaaatgggaaaacaatataaattatatttaacttccccaaagacgttttctcatttaggtgcatctttacttatttaaagatacatgtaggcagcaacacagggatttctttccctgtatctgttacgtagtattgcctaaaattttttgtaattcagacatttttttaatagtgatgttgtttgcattgtattttattttcatgggtttttttttctttaggatattgagaaagtctgtgaaactgtctatcaaggatctaacctaaacccagatcttggagaactggtggttgttcctttgtatccaaaagagaaatgttcattgttcaagccactcgatgaaacagaaaaaagatgccaagtttatcaaagaagagtggtgttaactactagctctggagagtttttgatctggagcaactcagtcagatttgttatcgatgtgggtgtggaaagaagaaaggtgtacaacccgagaataagagcaaactcgctcgtcatgcagcccatcagccagagccaggcagagatacgcaagcagattcttggctcatcttcttcaggaaaatttttctgcctgtacactgaagaatttgcctccaaagacatgacgccactgaagccagcagaaatgcaggaagccaacctaacaagcatggtgctttttatgaagaggatagacattgcgggcctaggccactgtgacttcatgaacagaccagcaccagaaagtttgatgcaggcattggaagacttagattatctggcagcactggataatgatggaaatctttctgaatttggaatcatcatgtcagagtttcctcttgatccacaactctcgaagtctatcttagcgtcctgtgaatttgactgtgtagatgaagtgctaacaatcgcagccatggtaacagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtactgtgtggaaaagtggtgtcgtgattacttcctcaactgttcagcactcagaatggcagatgttattcgagctgaactcttagaaattatcaagcgaatcgagcttccctatgcagaacctgcttttggctccaaggaaaacactctaaacataaagaaagctcttctgtccggttactttatgcagattgctcgggatgttgatggatcaggtaactacttaatgctgacacataagcaggttgctcagctgcatcccctgtctggttactcaatcaccaagaagatgccagagtgggtcctcttccataaattcagcatttctgagaacaactacatcaggattacctcagaaatctctcctgaactatttatgcagctggtaccacaatactatttcagtaatctgcctcctagtgaaagtaaggacattctacagcaagtagtggatcacctatcccctgtgtcaacaatgaataaggaacagcaaatgtgtgagacgtgccctgaaactgaacagagatgcactctccagtgactccccagcaaacacaaggtgcagcagggtcccaaaggtagctggatggctgaactgctggatatgggagatacatgacgcgaagacggatttcacatccacaggacggtcttgaagaaaataacactgtgtatattattttaaaataaaaaatagaagtttttattgagttctttaaattactactccatgcttttcttcttcttggaaaagtttttaaatcaaccactcataatttgaccaaaattttaaaaaactggtattttgtaaatgtgtcagagacacatgggacagaaccctactttttgtagaggaacttaatctgaataaagtctgagtttttcagtaaa

SEQ ID NO: 125607 - DNA, 803 bp, Homo sapiens
  Payload ID: 4620
  Gene Symbol: DHX32
  Gene Name: DEAH (Asp-Glu-Ala-His) box polypeptide 32
  ENST ID: ENST00000415732
  CDS Start-End: 467-803
ggccaggtcaccggctgaggacactgctcctgaagcccggtcaggcggtcgcgccctccctggcggcccccgcggccccgcaggacctgtgccccgacgtcgccgacccgcggtccccgctgtcgccgacccgcggcgtccgtcgggcgagtgggcctgcccgcgggtaaggcgccggccctgggccgccctcccgggaatcgggagccgccgctgcagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggttcctcagtggtgtgctgaatattgtctttccatccactaccagcacgggggcg

SEQ ID NO: 125608 - DNA, 5618 bp, Homo sapiens
  Payload ID: 4621
  Gene Symbol: DHX33
  Gene Name: DEAH (Asp-Glu-Ala-His) box polypeptide 33
  Uniprot ID: Q9H6R0
  ENST ID: ENST00000225296
  CDS Start-End: 202-2325
aaagccttcccaagcccccaaggcatgctgggagatgcagtccctttttctaaagactggggcggccgtgaggtcatcggtggtcgccgggagccgccagcacgtggcggcgaggaaggggcggtgtgctcctgttgtctgcacctgagagggggcaggagctctcggcgcttgcgcctcccgccgcggtgccctcccgacatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggggaaactggctctgggaagacaactcagatccctcagtacctgtatgaaggagggatcagccgccagggcatcattgctgtgacccagcctcgtcgagtagctgccatctctcttgctactagagtctcagatgagaagagaactgaacttgggaagctggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtcctcagtgcgtgaccctgtcagtgctttcaggagacatgtaagcttcctgggtgaaggttgatttgtaccttctgaatcctgtcacgtgtagacatgggaaactgacctatcagtgttttgtgtgtgtaggtgactcccacatacacagttgccatttttctctctaactgggcaccagtgaacatgcgggcatgaggagtgactgtgtaccatttcagctgtttcttttcgggcagtcccctggtcagagggggtgggggtgggggaggggagaggggtacctagaacccagagaacattggcttatgccagataccacaccacatctgggcttacattcttgtatcttttttggtgtgtgggcggggggggtggggggcagttcagtgaagtctagaagacctgctggacaaattctaaaagagctagagctgtaacacttattcttgcatcttattaattttctatgatattttttccttcttcgtagggacttgggacaatctggctttgctgctttctaactgctaggcacctctctctaaccctcattgtcagagggaattggaggatatccacagtctgttcctgttctgatattctgagcagagaaaaggcactaacggttcctcttagctatttaattatcagaagcaagtaatctttccccagataatattttgccctagaagaagccgtgatttagctcttttattgtgcttacttggtccaaatacatctgtggggtgttttgtcatttcttaatgaatgaatcatagttataaccaggggccaagctgcccaagaggctcttcagagatcatggatgctctctttctggaagctgtggcctgatggagcagccccattccagggtcccatctgtccggagttgtgtatgtcaagtccggctcagtctttatttccaacactagccgtggtcctgtgcagtcaagctctcagctagtgtttagggctgtctgtcagaaatggttatacgtgggcaaaagaagatctgacagctcctatataccttatcttactgaattcttaaactttgaaccagttcttccacttactgacttgttaccactgctgactttctgaaaagttttccagtttttgttttttgttttttgttttccagtaggggattagaatgtttagtcctacttagtaagaaaaatattgtatttttaatcattcatagtgctggtaaaaaaaaaaaaaaaaaaaaaaaaattggggggtggccgggcgcagtggctcacacctgtaatcccagcactttgggaggccaaggcgggcggatcacctcatgcctgtaatcccagcattgggatgggaggctgaggtgggtggattgcttgagaagttcaagaccagcctggccaacatggcaaaaccccgtctctactaaaaatagaaaacttagctgggcatggtggcacacgcctgtaatcccagctaccggggaggctgaggcacaagaattgcttgaacttgggaggcagagtttgtagtgagccaagatcacgccactgcattccagcctggccgacagtgtgagacggtctcagaaaaaaaaagaaagaaagaaagaaaaagaaaaaacttggggtaatttatgtccagcttaagtacctgaacagtttccggaaatgtatattttttttctgagaggcaaaggatgtaaacagcttctaagtagctttaatgtttctgtacagaaataagtttatccctgtaacattgtggtagagttttaatacagtatttagttttttattgggcttttttaaaaagttaacttttaacatagctgctcagggattaaatcagattggaaaacccattctgactccacatactgctacaaagaaatacatcgttgtttatattgagctgcaggagatagtacactttaaacttaagaaagttaaatgtttcacaataacattgcaatataatcttcagctactctctttccattggtaaaatctctgatggtgtgataactctttgccaacctacgaaacccatatctggaagaatcaccagctcccgtgagcagcttcatgtaaatagatgcactccaagcagattgcatgcctcaggtgtttgtcttctagtaatcatggagtgtgcaacacccagagtaacactacaaggggcaggactgcaaacagcaggtcctggctaaaaacccttaatgctgcattgctgccagttgtaaagagatgcctgaatggaggcaagttctgccctgtgggtgaaactgatgatgtactgtactgtcatatataaatccactaaatccagctaccaggaactgcctggaactgtggccatgcatttttttttttctttaaagaccagtgtgatagtaggccatgcatctgagatacgatattccttggtaactagagggagaaaaaaaaatcaagtaggttcaggcttatgttgtattttgagagtctggttttatttgaacagaaataactctacagaaagctcttgtaaataatgctcaaatttgcacccgacgatcaaatccattaaaaatgaatcttgtatatga

SEQ ID NO: 125609 - DNA, 2225 bp, Homo sapiens
  Payload ID: 4621
  Gene Symbol: DHX33
  Gene Name: DEAH (Asp-Glu-Ala-His) box polypeptide 33
  ENST ID: ENST00000433302
  CDS Start-End: 58-1509
ctgagagggggcaggagctctcggcgcttgcgcctcccgccgcggtgccctcccgacatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtcctca

SEQ ID NO: 125610 - DNA, 2040 bp, Homo sapiens
  Payload ID: 4621
  Gene Symbol: DHX33
  Gene Name: DEAH (Asp-Glu-Ala-His) box polypeptide 33
  ENST ID: ENST00000574023
  CDS Start-End: 1-282
aagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctg

SEQ ID NO: 125611 - DNA, 2564 bp, Homo sapiens
  Payload ID: 4621
  Gene Symbol: DHX33
  Gene Name: DEAH (Asp-Glu-Ala-His) box polypeptide 33
  ENST ID: ENST00000572490
  CDS Start-End: 1-1852
gcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtc

SEQ ID NO: 125612 - DNA, 4372 bp, Homo sapiens
  Payload ID: 4622
  Gene Symbol: DHX34
  Gene Name: DEAH (Asp-Glu-Ala-His) box polypeptide 34
  Uniprot ID: Q14147
  ENST ID: ENST00000328771
  CDS Start-End: 350-3781
acgagatggctgtgtgcgcaggcgcaagactagcgctcttgggaccggaagttaaggcgttcgcggcgtgtgaatccagggcctgaaaacccagaatgaacttgtgtccatcccagagatcactgcagatgtcatgaggtaccctttgtgtcaccagctcaagcaggcctctggccactttatcatctgtggtggtcctgtgccgtgaccaggaggaaaaattagctctttgaagagaaagtagttctctattgcaggcactggcctcttaaattgttgcaggtggggaatggatgagaatatttgttttgggtgatcagaactgagactcctattgtggattagtaacatgcctcctcctagaacaagggagggcagggatcgccgagaccaccaccgggctcccagcgaggaagaggccttggagaaatgggactggaattgtccagagacgcgtcgcctcttggaagatgccttcttccgtgaagaggattacatccgtcagggttctgaggaatgtcagaagttttggaccttctttgaacgcctgcagagattccagaatctcaagacctccaggaaggaggagaaagaccctggacagcccaagcacagcatcccagcgctggccgacctacctcgcacttacgacccacgttaccgcatcaacctctctgttcttggccctgccacgcggggctctcagggactgggcaggcacttgcccgcggagagagtggctgagttccgccgagccctgttgcactacctggactttggccagaagcaggcatttgggcgtctggccaagctgcagcgtgagcgggcagccctccccatcgcccagtatgggaaccgcatcctgcagacgctgaaggagcaccaggtggtggtagtggccggtgacaccggctgtggcaagtccactcaggtgccccagtacctgctggctgctggcttcagtcatgtggcgtgcacccagccccggcggatcgcctgcatctcactggccaagcgtgtgggctttgagagcctcagtcagtatggctcacaggtcggctaccagatccgctttgagagcacacgttcggcggccaccaagattgtattcctgacagtggggctgctcctgcgacaaatccagcgggaacccagcctgccccagtatgaggtcctgattgtggatgaagtccatgagcggcatctccacaacgatttcctcctgggcgtcctccagcgcctgttgcccacgcggcctgacctcaaggtcatcctcatgtcggccaccatcaacatctcgctcttctccagctatttcagcaatgcccctgtggtacaggtgcctgggaggctgttccccatcacggttgtgtaccagccgcaggaggcggagccgaccacgtccaagtcagagaagctggacccgcggcctttcctgagggtgctggagtccattgaccacaagtacccgcctgaggagcggggtgacctcctcgtcttcctcagcggcatggcggagatcagcgccgtgctggaggctgcccagacctatgccagccacacccagcgctgggtggtactgccactgcacagcgccctgtctgtggccgaccaggacaaggtatttgatgtggcaccccctggagtccggaaatgcatcctctccaccaacattgctgagacctcagtcaccattgacgggatccgcttcgtagtagattccggaaaggtgaaggagatgagctacgatccgcaggccaagctgcaacggctgcaggagttctggattagtcaggccagcgcagagcagcggaagggccgggcgggccgcacgggccccggagtctgcttccgcctctatgccgaatcggactatgatgccttcgccccctaccccgtcccagaaattcggagggtggccctggactcgttggtgctgcagatgaagagcatgagtgtgggggacccccgaaccttccccttcatcgagcccccaccaccagccagcctggaaaccgccatcctctacctccgggaccagggggccctggacagctcagaggccctcacacccattgggtccctgctagcccagctgcctgtggacgttgtgattgggaagatgctgatcctgggctccatgttcagcctggtggagcctgtgctcaccatcgcagccgcacttagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgagacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgatacacactgttaggcctgcacctgcccatccagaaagcagcagctgccttgttagtcctccccagggtctagctttccttcttcctgctgcagggtgctgcctgaggggtcctgggtaggaggggcgttagagccagcagggacctcccatgtctccagattccaggtgcaggttcttagcacctccgcagccgctctctcttgagtccatcctcagtctctcctaccccttgaagtagggggaccctgaatttgcccatccacctgggtcactttgagagttgtgcaggggggctgggagcactggtgttcacgtgggaccacaggctgcaccataagacccactcacaataaaaaaataaaaggccgagccgggcatggttgctcactcccgtaataaaaaaataaaagaacaggctgagccggg

SEQ ID NO: 125613 - DNA, 1838 bp, Homo sapiens
  Payload ID: 4622
  Gene Symbol: DHX34
  Gene Name: DEAH (Asp-Glu-Ala-His) box polypeptide 34
  ENST ID: ENST00000460681
  CDS Start-End: 1-817
tagcgtccagtcgcccttcacccgcagcgcccagagcagcccagagtgcgcggcagcacggcggccgctggagagcgaccagggtgaccccttcacgctcttcaacgtcttcaacgcctgggtgcaggtgaaatctgaacggagcagaaactctcgcaagtggtgccgccgccggggcatagaggagcatcgactgtacgaaatggccaaccttcggcgccagttcaaggagctgttggaggaccacgggctgctggctggggcccaggccgcgcaggtaggggacagctacagtcggttgcagcagcgccgggagcgccgggccctgcaccagctgaaacgccagcacgaggagggcgcggggcgcaggcgcaaggtgctgcggctgcaggaggagcaggacggcggctccagtgacgaggacagggctggcccagcccccccaggggccagtgatggcgtggacatccaggatgtgaagttcaagcttcggcatgacctggcgcagctgcaggccgctgccagctcagcccaggacctgagccgcgagcagctggctctgctgaagctggtgctgggccggggcctgtacccacagctggccgtccccgacgccttcaacagcagccgaaaggactcagaccagattttccacacgcaggccaagcagggcgccgtgctgcaccccacctgcgtcttcgctggcagccccgaggtgctgcacgcacaggagctggaggccagcaactgcgacggaagccgaggcatggctgcgtgctgggagtcacattcagatttggctgaccttcttgtctgagccaggccaccaaagccatgccacgacaaggacaagatgagcagcaaacaccagctcctcagcttcgtgtccctgctggagaccaacaagccgtacctggtgaactgcgtccgcatccctgccctccagtccctcctgctttttagccggtctttggacaccaatggtgactgctcccgcctggtggccgatggctggctggagctgcagctagcagacagtgaaagtgccatccgactcctggcggcttccctgcggctccgtgcccgctgggaaagtgccctggaccggcagctggcgcaccaggcccagcagcagctggaggaggaggaggaggatacgccagtcagccccaaggaggtggccaccctgagcaaggaactcctgcaattcacggcatccaagattccttacagcctccggcggctcacagggctagaagtccagaacatgtatgtgggaccccagaccatcccagccaccccccatcttcctggcctctttggcagctccaccctgtccccccaccccacaaaggggggctacgcagtcactgacttcctcacctacaactgcctcacgaatgacacagacctgtacagcgactgtctccgaaccttctggacctgcccccactgtggcctgcatgcgcccctcacgcccctggagcgcatcgcccatgagaacacctgcccccaggccccacaggatgggcccccaggggctgaggaagctgccctcgaaaccctccagaagacatctgtcctgcagaggccctaccactgcgaggcctgcgggaaggacttcctctttacacccacagaggtgctgcgccaccggaagcagcacgtgtgagctgggccaggagccctgcccacctccgtgcagctgacctgccctccagcccaggactaggggcaggactcttgcctgaacccccagcctgggcttagccctgtggtcctgtcccagtgcagagggcctggagcacggattgtgaataaagcctcacatgctgata

SEQ ID NO: 125614 - DNA, 3325 bp, Homo sapiens
  Payload ID: 4623
  Gene Symbol: DHX35
  Gene Name: DEAH (Asp-Glu-Ala-His) box polypeptide 35
  Uniprot ID: Q9H5Z1
  ENST ID: ENST00000252011
  CDS Start-End: 34-2145
ggtggagctagcctcgtgaccttttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagcttaggaatcatattttatacttgatagaaaattatcagacagtggtgattgttggtgaaacaggatgtgggaagagcacacagattcctcagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctcccaca

SEQ ID NO: 125615 - DNA, 2347 bp, Homo sapiens
  Payload ID: 4623
  Gene Symbol: DHX35
  Gene Name: DEAH (Asp-Glu-Ala-His) box polypeptide 35
  Uniprot ID: Q9H5Z1
  ENST ID: ENST00000373323
  CDS Start-End: 25-2043
agcctcgtgaccttttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctg

SEQ ID NO: 125616 - DNA, 3287 bp, Homo sapiens
  Payload ID: 4623
  Gene Symbol: DHX35
  Gene Name: DEAH (Asp-Glu-Ala-His) box polypeptide 35
  ENST ID: ENST00000373325
  CDS Start-End: 70-2109
ccctccgggccctgggggcctagcgcgcgacggtggggtggagctagcctcgtgaccttttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagcttaggaatcatattttatacttgatagaaaattatcagacagtggtgattgttggtgaaacaggatgtgggaagagcacacagattcctcagtaccttgcagaagccggctggacagctgaaggaagagtggtaggagtgacccagcctcgaagagtggctgctgttacagttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttatagggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctccca

SEQ ID NO: 125617 - DNA, 607 bp, Homo sapiens
  Payload ID: 4623
  Gene Symbol: DHX35
  Gene Name: DEAH (Asp-Glu-Ala-His) box polypeptide 35
  ENST ID: ENST00000449559
  CDS Start-End: 1-504
atcgctgccatgatgcagatccagaatatctttgtggtccccccaaaccagaagtctcacgcacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatg

SEQ ID NO: 125618 - DNA, 3318 bp, Homo sapiens
  Payload ID: 4623
  Gene Symbol: DHX35
  Gene Name: DEAH (Asp-Glu-Ala-His) box polypeptide 35
  ENST ID: ENST00000484417
  CDS Start-End: 9-389
accccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagcttaggaatcatattttatacttgatagaaaattatcagacagtggtgattgttggtgaaacaggatgtgggaagagcacacagattcctcagtaccttgcagaagccggctggacagctgaaggaagagtggtaggagtgacccagcctcgaagagtggctgctgttacacatgatctttcttcccaaaggttgcagggagagtagctgaagaaaggggtgcagtgctgggccacgaggtgggctactgcatccgctttgatgactgcaccgaccagctggccacgagaattaagtttcttactgatggaatgctggtcagggaaatgatggttgatccgttgttaacaaaatatagtgtcatcatgctggatgaagcccacgagaggaccttgtacactgacattgccattggcttgctaaaaaagattcagaaaaagcgaggggatcttcgattgattgtagcttcagccactctggatgcagacaaattccgggatttctttaatcaaaatgaaaccagtgatccagcaagggatacatgtgtgatccttacagtggaagggagaacatttccggtggatatcttttatctacaaagtcctgttccagattatatcaaatcaactgtcgaaactgtggtgaaaattcaccagacagagggagacggagacgttttagcatttcttactggccaggaagaggtagaaactgttgtgtcgatgctcatcgagcaggctcgagcactagctcgcactgggatgaagagacacctccgagttctccccatgtatgcaggactgccttcctttgagcaaatgaaagtgtttgaaagggtgtcacgcagtgtcagaaaggtgatagtggccaccaatgtggcagaaacctctatcacaatcagcggcattgtgtatgtgatcgactgtggctttgtgaaactccgagcctacaatcccaggacagctattgaatgcttggtggtggtgccagtctcccaggcatcagctaatcagcgagcaggacgtggtggtcgtagtcgctcgggaaaatgttatcgcctttatacagaggaagcctttgacaagttgcctcagtctacggttcctgagatgcagcgtagtaatttggcacctgtcatcctgcagctgaaagcactaggaattgacaatgtcctcaggttccacttcatgtcgccccctccagcacagtcgatggttcaagccttggagttactgtatgctctgggaggtctggacaaagactgtcgcctaactgaaccgcttggcatgagaattgcagagtttcctttgaatcccatgtttgccaaaatgctgcttgaatcaggaaacttcggctgttctcaggaaattctaagcatcgctgccatgatgcagatccagaatatctttgtggtccccccaaaccagaagtctcacgcaattcgagtgcaccgtaaatttgctgtggaggagggcgaccacctcactatgctcaatatatatgaagcatttatcaaacacaataaggactctaaatggtgtcaggaacatttcctgaattacaagggtcttgtcagagctgcgactgtaagagaacaattgaaaaagcttcttgtcaagtttcaagtgcccaggaagtctagtgaaggtgacccggatctggttctgaggtgcattgtctccggcttcttcgccaatgcagcgaggtttcattctactggagcttataggaccatccgtgatgaccatgagctgcacatacaccctgcgtcagtcctctatgcagagaagccgcctcgctgggtcatctataacgaagttatacagacctccaagtactacatgagagatgtgactgccattgaatcggcctggctgttggagctggctccacacttttatcaacaaggaacgcacctgtctctgaaagccaaaagggccaaggtccaggacccgtgagaggagcccacagctacagctgcagggactgctggcgtcctctcctccatgctgctgcccctggtcccaggtggggtgagctggcaccagctcctgtggaatgtttggttgctctgaagtgggctgcggcctgttcattagtcctttcttcccgctgcccacagcatttgcatccttgctgggatcctggaggactttgtgcatgggcaggcatccttctgtgctgcagcgggcagagtgggagttggctcactcagcacgctcactaacccagcatgccacttccagcaggcatgcagtcctggcccagctctatgggaaacaaggaggaaagttagccactgaaggccaaaacaccatgtggggtggacagagggtttgctgggctggctttgctttccctgctggggccacagctgtgttaaccaatgaggtctgctgccaggtgtgaacaagcatgtctctacgaatgaacgaaacattggggatctctgccgaaaccaccaaagggcatgtctgatgggcacagggtctcccaaacccagtggcttctgtctgtcctcagcccttgtccctgtttatctgcagccaggagacttgcaagggattggtgattgacagagaggactcgtgcgctgttttgtgttagcagaggatttgtgtttcacaggtaggcttagcgtcctctcagagtgtagtgccaggtcctggtgccacgctagctgagcactcaggagagttcatcagctcagatcccacagggcctcctctttagcaggaattcacaacagtttggatgccctaaacttctgtagctcaggaacatcactggtgtatttgtttttttgtttgtttgcttgggttcttgcaagagcgcgtggggacagttcttccagcaggcactggttttgttgccccagggctgctttgctgtgatgatgattgcatttcaacacatgccagatgcagattttttcccccttactgtttcaatgacctttattttaaaaacacatagcttgaaaatttatttttatactgatattagtttggatgtgccacttttggcaccaaacgtgtatgtcatttttatttccattttataaacatgtaaataatagtgataacttgttaataatagtaaacctttatacctaaagtaaatgtcttccctccca

SEQ ID NO: 125619 - DNA, 3487 bp, Homo sapiens
  Payload ID: 4624
  Gene Symbol: DHX36
  Gene Name: DEAH (Asp-Glu-Ala-His) box polypeptide 36
  Uniprot ID: Q9H2U1
  ENST ID: ENST00000308361
  CDS Start-End: 45-2984
ttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctca

SEQ ID NO: 125620 - DNA, 2985 bp, Homo sapiens
  Payload ID: 4624
  Gene Symbol: DHX36
  Gene Name: DEAH (Asp-Glu-Ala-His) box polypeptide 36
  Uniprot ID: Q9H2U1
  ENST ID: ENST00000329463
  CDS Start-End: 1-2985
atgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctga

SEQ ID NO: 125621 - DNA, 6733 bp, Homo sapiens
  Payload ID: 4624
  Gene Symbol: DHX36
  Gene Name: DEAH (Asp-Glu-Ala-His) box polypeptide 36
  Uniprot ID: Q9H2U1
  ENST ID: ENST00000496811
  CDS Start-End: 82-3108
aagtgggcgcacagtggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcagccaacctcttggattggtttctacattttcacctatggcttggttcatttgatatttttactatttttaaaacacgtgccctttttatatcaccctgtgcctcataatacagcaattgagagcacggtctggagcctgattacctcagttccagtctcagctctgtcagttagtcagtgtcttggcttctctcctttttccttatcttgtaagatacagttggcccttcatatccatgcattccacatctgtggattcaaacaactgtggatagaagatatttggggaaaaaaaggatggttgtgtctatactgaacatgtgcagacttttttccttgtcattccctaaacaatacagtttaacagctatttatatagtatttacattgtattaggtattataaataatctagagatgacttaaagaatatgggaggttgtgcctaggtaacatgcaaatactacgccattttattataaaagacttgagcatccatggatttaggtatttgaggggttggggttggaaaccagtcccccacagatactgagggacaactgtacatgtaacagttgtgaggatgaagtacattaatacatgtaaagcacataggctagtgcctgtactctctgaatcttagttgttatttgtccctgaaatattttcgtaaatgtctaacaatctattatattacactttttattttattgctacttatcttcttcgccaaggaatagtgtaacaacacatgctgtacattttcagccctatcagattgtgataaatactgttggttgccggccagcaactattttgtccctcccttcttgcttgcttattctggtgttcccttctgtgcagctctgtgtccaggtatgttggaccctttccctaagggtgaatcctgctgttctaaatgaatcacatgtggtcttatcccccttataagtaattgataaggcatgagtacataaacatgtcctagtgaatggcagctgagaagtgatcttcaagggggtgtctgaaaaatgttttactcactaataggcttagaggaggaaatcctgctctctctggacattgtcttttctgactctgatagttggaactgctgcagccaactaatgatcacaaggagacacggactcagactgaggttagctcagtggaaagatagaactcaccagagcctttgataatgccggtaagcttcagaattaacccattctagagctgctttacatgtggacttatgttgatataataaaaacccttcaattgtttaagccacttttaataggatattgttagttttttgttggttttttgttttgttttgttttgttttttgttttttggagacagtgtcttgccctgtcacccaggctggagtgcagtggtgtgatcttggttcactgcagcctcgacttcctgggttcaagtgatccttctgcctcagcctcccaaatagctgggactataggcatgcatcaccacacccagctaatttctgtattttttgtagagacaccgtttcaccatgttgcccaggctggtctcaaaactcctgtgctcaagcagtctgcccgccttggcttcccaaagtgctgacattacaggtatgagccactgcacccggtccctagtagggtatttttaacttggcaaaaagggtattaatcagaaacatacactatccatcactgagtattatactcttgattttgcaatgtaagagttttaacctatttgtctgacagaaggtgtaaaagtgctggacatgctgcagaaagaaacaggaaaagcatcttgctgcactccaaagaatgcaaattttaatgtgccttccaataaatgcaaggaaaccgaaagagttaatagtatcatacaatgactgggatgtattgataatgctacagtgatccattaacagcacttgttcaggtactgctcccaatcctgggaatgtgtgttacctgttatgtctcaaatcctttatcttggctgttcttctaaaagtgatctgtctgtcattgaatgctggcattagagtcatgtcacaatattagagcatactggttttgcctctaacgtcgaggtgaccatctggtctttcttgctctgtaagagtttctgtttgtgcttttttttcccttacttttattatccagtttaaatccagtcagttggccaaaatggtcttggaagaaaggatttagagattctgtaaaaaagattattagttggttctgtgtttgcaaaccagtatgtaattcccatatgaatggggaaaatgttcctgaggaattatttaattgatgaggcattcacagagattaaagcagttattgttacctccaatttatgtcttctgcacagctgattaggttggacattttaatccaaggtgctacttacattctgtttcttttgtttacaaaatagggcattactgagtagaaaatacattccaggtctaagaactgtttgttctttagtggattttaaagaataagacattaaattaagaaggaaaatctgtttgattcatcattttgagtaatgcagagaataactcttaaaaaaaaaacctgaaacagaaactttcaggaaaaaaacaaaagaaattaaactactgaataatctttcaaaagcatcgttgaacagtgagcacatgtgatgccttcccaattaattaatttgggcaaaagctctagataaacttacaccaattgttgcaaggcattctctattactgcatttttaaaacaaagtcctcccctaaaagttatgaattatacaaaagctttaggaggaattttagtactcctttacccaaaataaatagtggtaaatttccttctgttcttagctctgagtttgtatttatttataagtcattgtgatcatgtatacttatatatttttaatatgctaattgcttttaaatgggatttttgttctgattttaaaataatacatcctccctggacaatatttggaaatgtagcaaagtaaatcatgttaccattgttccattttgatatatataaactttaggtattattttatatataataaattttaagatattatatacaataaaattaaccaatttaa

SEQ ID NO: 125622 - DNA, 530 bp, Homo sapiens
  Payload ID: 4624
  Gene Symbol: DHX36
  Gene Name: DEAH (Asp-Glu-Ala-His) box polypeptide 36
  ENST ID: ENST00000479934
  CDS Start-End: 1-360
aacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatc

SEQ ID NO: 125623 - DNA, 562 bp, Homo sapiens
  Payload ID: 4624
  Gene Symbol: DHX36
  Gene Name: DEAH (Asp-Glu-Ala-His) box polypeptide 36
  ENST ID: ENST00000469977
  CDS Start-End: 1-562
ttatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgc

SEQ ID NO: 125624 - DNA, 2612 bp, Homo sapiens
  Payload ID: 4624
  Gene Symbol: DHX36
  Gene Name: DEAH (Asp-Glu-Ala-His) box polypeptide 36
  ENST ID: ENST00000481941
  CDS Start-End: 220-2612
ctagaagcagggtatttgagaatgtccaagaaagtgggaaataatcaaaattctatgataaaagaaaatagtcatgaaaaaaatgtgttttgagattctccaggcaaggagtgaaataaagtgaagcgtggtagaactagaagaaggttgttgagggggagagaggcatcctacaaaaaggcaagatccaagtttggaattaagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaa

SEQ ID NO: 125625 - DNA, 185 bp, Homo sapiens
  Payload ID: 4624
  Gene Symbol: DHX36
  Gene Name: DEAH (Asp-Glu-Ala-His) box polypeptide 36
  ENST ID: ENST00000630536
  CDS Start-End: 1-15
ataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatc

SEQ ID NO: 125626 - DNA, 4276 bp, Homo sapiens
  Payload ID: 4624
  Gene Symbol: DHX36
  Gene Name: DEAH (Asp-Glu-Ala-His) box polypeptide 36
  ENST ID: ENST00000626678
  CDS Start-End: 1-651
atgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctcagccaacctcttggattggtttctacattttcacctatggcttggttcatttgatatttttactatttttaaaacacgtgccctttttatatcaccctgtgcctcataatacagcaattgagagcacggtctggagcctgattacctcagttccagtctcagctctgtcagttagtcagtgtcttggcttctctcctttttccttatcttgtaagatacagttggcccttcatatccatgcattccacatctgtggattcaaacaactgtggatagaagatatttggggaaaaaaaggatggttgtgtctatactgaacatgtgcagacttttttccttgtcattccctaaacaatacagtttaacagctatttatatagtatttacattgtattaggtattataaataatctagagatgacttaaagaatatgggaggttgtgcctaggtaacatgcaaatactacgccattttattataaaagacttgagcatccatggatttaggtatttgaggggttggggttggaaaccagtcccccacagatactgagggacaactgtacatgtaacagttgtgaggatgaagtacattaatacatgtaaagcacataggctagtgcctgtactctctgaatcttagttgttatttgtccctgaaatattttcgtaaatgtctaacaatctattatattacactttttattttattgctacttatcttcttcgccaaggaatagtgtaacaacacatgctgtacattttcagccctatcagattgtgataaatactgttggttgccggccagcaactattttgtccctcccttcttgcttgcttattctggtgttcccttctgtgcagctctgtgtccaggtatgttggaccctttccctaagggtgaatcctgctgttctaaatgaatcacatgtggtcttatcccccttataagtaattgataaggcatgagtacataaacatgtcctagtgaatggcagctgagaagtgatcttcaagggggtgtctgaaaaatgttttactcactaataggcttagaggaggaaatcctgctctctctggacattgtcttttctgactctgatagttggaactgctgcagccaactaatgatcacaaggagacacggactcagactgaggttagctcagtggaaagatagaactcaccagagcctttgataatgccggtaagcttcagaattaacccattctagagctgctttacatgtggacttatgttgatataataaaaacccttcaattgtttaagccacttttaataggatattgttagttttttgttggttttttgttttgttttgttttgttttttgttttttggagacagtgtcttgccctgtcacccaggctggagtgcagtggtgtgatcttggttcactgcagcctcgacttcctgggttcaagtgatccttctgcctcagcctcccaaatagctgggactataggcatgcatcaccacacccagctaatttctgtattttttgtagagacaccgtttcaccatgttgcccaggctggtctcaaaactcctgtgctcaagcagtctgcccgccttggcttcccaaagtgctgacattacaggtatgagccactgcacccggtccctagtagggtatttttaacttggcaaaaagggtattaatcagaaacatacactatccatcactgagtattatactcttgattttgcaatgtaagagttttaacctatttgtctgacagaaggtgtaaaagtgctggacatgctgcagaaagaaacaggaaaagcatcttgctgcactccaaagaatgcaaattttaatgtgccttccaataaatgcaaggaaaccgaaagagttaatagtatcatacaatgactgggatgtattgataatgctacagtgatccattaacagcacttgttcaggtactgctcccaatcctgggaatgtgtgttacctgttatgtctcaaatcctttatcttggctgttcttctaaaagtgatctgtctgtcattgaatgctggcattagagtcatgtcacaatattagagcatactggttttgcctctaacgtcgaggtgaccatctggtctttcttgctctgtaagagtttctgtttgtgcttttttttcccttacttttattatccagtttaaatccagtcagttggccaaaatggtcttggaagaaaggatttagagattctgtaaaaaagattattagttggttctgtgtttgcaaaccagtatgtaattcccatatgaatggggaaaatgttcctgaggaattatttaattgatgaggcattcacagagattaaagcagttattgttacctccaatttatgtcttctgcacagctgattaggttggacattttaatccaaggtgctacttacattctgtttcttttgtttacaaaatagggcattactgagtagaaaatacattccaggtctaagaactgtttgttctttagtggattttaaagaataagacattaaattaagaaggaaaatctgtttgattcatcattttgagtaatgcagagaataactcttaaaaaaaaaacctgaaacagaaactttcaggaaaaaaacaaaagaaattaaactactgaataatctttcaaaagcatcgttgaacagtgagcacatgtgatgccttcccaattaattaatttgggcaaaagctctagataaacttacaccaattgttgcaaggcattctctattactgcatttttaaaacaaagtcctcccctaaaagttatgaattatacaaaagctttaggaggaattttagtactcctttacccaaaataaatagtggtaaatttccttctgttcttagctctgagtttgtatttatttataagtcattgtgatcatgtatacttatatatttttaatatgctaattgcttttaaatgggatttttgttctgattttaaaataatacatcctccctggacaatatttggaaatgtagcaaagtaaatcatgttaccattgttccattttgatatatataaactttaggtattattttatatataataaattttaagatattatatacaataaaattaaccaatttaa

SEQ ID NO: 125627 - DNA, 651 bp, Homo sapiens
  Payload ID: 4624
  Gene Symbol: DHX36
  Gene Name: DEAH (Asp-Glu-Ala-His) box polypeptide 36
  ENST ID: ENST00000627269
  CDS Start-End: 1-651
atgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctga

SEQ ID NO: 125628 - DNA, 1154 bp, Homo sapiens
  Payload ID: 4624
  Gene Symbol: DHX36
  Gene Name: DEAH (Asp-Glu-Ala-His) box polypeptide 36
  ENST ID: ENST00000630672
  CDS Start-End: 1-651
atgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctca

SEQ ID NO: 125629 - DNA, 275 bp, Homo sapiens
  Payload ID: 4624
  Gene Symbol: DHX36
  Gene Name: DEAH (Asp-Glu-Ala-His) box polypeptide 36
  ENST ID: ENST00000629736
  CDS Start-End: 1-275
atgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaa

SEQ ID NO: 125630 - DNA, 4550 bp, Homo sapiens
  Payload ID: 4625
  Gene Symbol: DHX37
  Gene Name: DEAH (Asp-Glu-Ala-His) box polypeptide 37
  Uniprot ID: Q8IY37
  ENST ID: ENST00000308736
  CDS Start-End: 100-3573
tctcacggccggagttggtggtctgggaacccacgtgggctgggtttcggattgctctgctggtccggccgctggagcgcccaccctggcctagtcgccatggggaagctgcgccggcgctacaacatcaaggggcgccagcaggcgggccccggaccctcgaagggcccccccgagccgccccccgtgcagctggaactggaggacaaggacacgttgaagggagttgatgcaagcaacgcgctcgttctaccggggaagaagaaaaagaagaccaaagcccctcccctgtcgaagaaggagaagaagcctctgaccaagaaggagaagaaagtgctgcagaaaatcttagaacagaaggagaaaaagagccagcgagcagagatgctacagaagctgagtgaagtccaggcttccgaagctgagatgagactcttttataccacttccaagctaggcactgggaaccgcatgtatcacaccaaagagaaggctgacgaggtggtagccccgggccaggagaagatcagtagcctcagcggtgcccaccggaagcgtcgccgctggccctcagctgaggaggaggaggaggaggaggaggagtcggaatcggagctggaggaggagtcggagctggacgaggacccagctgctgagccggctgaggctggtgtggggaccaccgtggcacctctgccgccagctccagcacccagcagtcagcccgtgccggctgggatgactgttcctcctcctccagctgcagccccaccactgcccagggccctggctaagcccgccgtcttcatccccgtgaaccgctccccggaaatgcaggaggaacggctgaagctcccaattctctccgaagaacaagtaatcatggaggctgtggccgagcaccccatcgtcatcgtgtgtggtgagaccggcagcgggaagaccacacaggtgcctcagtttctctatgaagcaggcttcagcagtgaagacagcatcatcggtgtcacggagccccgccgagtggccgccgtggccatgtcccagcgagtggccaaggagatgaatctgtcccagcgggtcgtctcctaccagatccggtatgaaggaaacgtgacagaggagaccagaatcaagttcatgacggatggtgtgctgcttaaagaaatccagaaggacttcctgctgctgcggtacaaggtggtgatcatcgacgaggcccacgagaggagcgtgtacacggacatcctcatcggcctcctgtcccgcattgtgactctccgggctaagaggaacctgccactcaagctgctcatcatgtcggccacgctgcgggtggaggacttcacccagaacccacggctcttcgccaagccgccgccggtcatcaaggtggaatccaggcagttcccagtgactgtgcatttcaacaagcggacaccgctggaagactacagtggcgagtgcttccggaaggtctgcaagatccaccggatgctgcccgcaggtggcatcctggtgttcctgacggggcaggctgaggtgcatgcgctgtgccgcaggctcaggaaggctttcccaccctccagagcccggccacaagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaaggtcatcaacttccccttcccgacgcccccctccgtggaagcccttcttgccgccgaggagctgttgatcgcactgggtgccctgcaaccgccccagaaagcagaaagggtgaagcaactgcaggagaaccggctgagctgccccatcactgcgctgggccggacaatggccacattccccgtggcaccccgctacgctaagatgctggcactgagccgacaacacggctgcctgccctatgccatcaccatcgtggccagcatgacggtgcgggagctgtttgaggagctggacagaccagcggccagtgacgaggagctcaccaggctgaagagcaagcgggcccgggtggcccagatgaagaggacctgggcagggcagggggcttctctgaagctcggcgacctcatggtgctgctgggcgccgtgggagcctgtgagtatgccagctgcacaccccagttttgcgaagccaacgggctgcggtacaaagccatgatggagatccggcgcctgcggggccagctgaccaccgcagtcaatgccgtgtgccccgaggctgagctcttcgtggatcccaagatgcagccgcccaccgagagccaggtgacctacctgcgacagatcgtgacggcaggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgcccggttcctgctggaagggcaggtcttccgcaagctggcctcataccggagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcacccag

SEQ ID NO: 125631 - DNA, 4112 bp, Homo sapiens
  Payload ID: 4625
  Gene Symbol: DHX37
  Gene Name: DEAH (Asp-Glu-Ala-His) box polypeptide 37
  ENST ID: ENST00000544745
  CDS Start-End: 111-2999
cggagctggacgaggacccagctgctgagccggctgaggctggtgtggggaccaccgtggcacctctgccgccagctccagcacccagcagtcagcccgtgccggctgggatgactgttcctcctcctccagctgcagccccaccactgcccagggccctggctaagcccgccgtcttcatccccgtgaaccgctccccggaaatgcaggaggaacggctgaagctcccaattctctccgaagaacaagtaatcatggaggctgtggccgagcaccccatcgtcatcgtgtgtggtgagaccggcagcgggaagaccacacaggtgcctcagtttctctatgaagcaggcttcagcagtgaagacagcatcatcggtgtcacggagccccgccgagtggccgccgtggccatgtcccagcgagtggccaaggagatgaatctgtcccagcgggtcgtctcctaccagatccggtatgaaggaaacgtgacagaggagaccagaatcaagttcatgacggatggtgtgctgcttaaagaaatccagaaggacttcctgctgctgcggtacaaggtggtgatcatcgacgaggcccacgagaggagcgtgtacacggacatcctcatcggcctcctgtcccgcattgtgactctccgggctaagaggaacctgccactcaagctgctcatcatgtcggccacgctgcgggtggaggacttcacccagaacccacggctcttcgccaagccgccgccggtcatcaaggtggaatccaggcagttcccagtgactgtgcatttcaacaagcggacaccgctggaagactacagtggcgagtgcttccggaaggtctgcaagatccaccggatgctgcccgcaggtggcatcctggtgttcctgacggggcaggctgaggtgcatgcgctgtgccgcaggctcaggaaggctttcccaccctccagagcccggccacaagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaaggtcatcaacttccccttcccgacgcccccctccgtggaagcccttcttgccgccgaggagctgttgatcgcactgggtgccctgcaaccgccccagaaagcagaaagggtgaagcaactgcaggagaaccggctgagctgccccatcactgcgctgggccggacaatggccacattccccgtggcaccccgctacgctaagatgctggcactgagccgacaacacggctgcctgccctatgccatcaccatcgtggccagcatgacggtgcgggagctgtttgaggagctggacagaccagcggccagtgacgaggagctcaccaggctgaagagcaagcgggcccgggtggcccagatgaagaggacctgggcagggcagggggcttctctgaagctcggcgacctcatggtgctgctgggcgccgtgggagcctgtgagtatgccagctgcacaccccagttttgcgaagccaacgggctgcggtacaaagccatgatggagatccggcgcctgcggggccagctgaccaccgcagtcaatgccgtgtgccccgaggctgagctcttcgtggatcccaagatgcagccgcccaccgagagccaggtgacctacctgcgacagatcgtgacggcaggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgcccggttcctgctggaagggcaggtcttccgcaagctggcctcataccggagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatgtgagtttgaccagggccagggggtgggagtagacaggatggggtcactgaggcaggggctttgtgctttgtgcacggtcagccctggcttggcagaaggatctggccccacggctgctggccagctttttgccacctgaggagagtccctgggcccagggtcaccctgacactgtcctccttccctcccctgcagacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgc

SEQ ID NO: 125632 - DNA, 669 bp, Homo sapiens
  Payload ID: 4625
  Gene Symbol: DHX37
  Gene Name: DEAH (Asp-Glu-Ala-His) box polypeptide 37
  ENST ID: ENST00000543962
  CDS Start-End: 269-669
ccatcccccacctcacccccgaataaatggccaccactgagtggccatgccttgaacaacaaagggcagtgtgctggcgaccacgccggccacagacgcctttctccccaacctgcccctctcccagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacagg

SEQ ID NO: 125633 - DNA, 4608 bp, Homo sapiens
  Payload ID: 4626
  Gene Symbol: DHX38
  Gene Name: DEAH (Asp-Glu-Ala-His) box polypeptide 38
  Uniprot ID: Q92620
  ENST ID: ENST00000268482
  CDS Start-End: 510-4193
aagcgcagaaaagaaactcctggccgtcggtcggcccccgctcaacagcccaataaacggaagagcttctagtcaccgcccaccttgctcggctctgaccggaagctaggcgtcacctccgcccgtattaaagatggtcgacctttttcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgctacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 125634 - DNA, 892 bp, Homo sapiens
  Payload ID: 4626
  Gene Symbol: DHX38
  Gene Name: DEAH (Asp-Glu-Ala-His) box polypeptide 38
  ENST ID: ENST00000567142
  CDS Start-End: 1-575
ccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaaca

SEQ ID NO: 125635 - DNA, 710 bp, Homo sapiens
  Payload ID: 4626
  Gene Symbol: DHX38
  Gene Name: DEAH (Asp-Glu-Ala-His) box polypeptide 38
  ENST ID: ENST00000566794
  CDS Start-End: 297-710
aataaacggaagagcttctagtcaccgcccaccttgctcggctctgaccggaagctaggcgtcacctccgcccgtattaaagatggtcgacctttttcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatgagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggag

SEQ ID NO: 125636 - DNA, 574 bp, Homo sapiens
  Payload ID: 4626
  Gene Symbol: DHX38
  Gene Name: DEAH (Asp-Glu-Ala-His) box polypeptide 38
  ENST ID: ENST00000566489
  CDS Start-End: 206-574
attaagggacaataatggccgctttcaaggtgtggattttggctccttgagcctgtctgagcgaggggtggcagcgccggcgccccagaatccgggacagaagggtcccaagagtcgcgcttggtgagtgtcatttataccaggcaatctggtgggcgatctcttctactagaatgtcagctccagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggt

SEQ ID NO: 125637 - DNA, 2258 bp, Homo sapiens
  Payload ID: 4626
  Gene Symbol: DHX38
  Gene Name: DEAH (Asp-Glu-Ala-His) box polypeptide 38
  ENST ID: ENST00000579387
  CDS Start-End: 225-653
acttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgt

SEQ ID NO: 125638 - DNA, 706 bp, Homo sapiens
  Payload ID: 4626
  Gene Symbol: DHX38
  Gene Name: DEAH (Asp-Glu-Ala-His) box polypeptide 38
  ENST ID: ENST00000563819
  CDS Start-End: 1-564
ctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctgg

SEQ ID NO: 125639 - DNA, 500 bp, Homo sapiens
  Payload ID: 4626
  Gene Symbol: DHX38
  Gene Name: DEAH (Asp-Glu-Ala-His) box polypeptide 38
  ENST ID: ENST00000562774
  CDS Start-End: 1-387
gtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaac

SEQ ID NO: 125640 - DNA, 3660 bp, Homo sapiens
  Payload ID: 4627
  Gene Symbol: DHX40
  Gene Name: DEAH (Asp-Glu-Ala-His) box polypeptide 40
  Uniprot ID: Q8IX18
  ENST ID: ENST00000251241
  CDS Start-End: 148-2487
ccacgtcatcgagcagctccccctccccttgctacaagtcgcacgcgcggaagtaaacacctctacgtcatcagggcgcgtcctcgtctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcagggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactaccaagaggaggtggtcagcacttgttattggcctatgaactaaaagcaaatcaaagctcataaatcaaagctcatcagttcccataaatgcagttgtcaaagaaaagatttggttgccatagtcataagcaatgatacatgaaaccaatgaaagacagtacatgtaataatattttcctcagtacaattttgctggccttaactggtatcaaacgctgtcattgagatgttttcaaagaacattgagttgtatttaatcagcgtgtactccatttgcattgaagcattaaaaattatttttcttaaaatctctttaaggccttcttgttgctgttagaatagtgctatatatcaggtatgtgaccatttatttcagaaggctgaacataagaggtttctactcagcaatacttagatgtctaactgtttaattgctacagagctttatagatatttagagaaaagacttaatcaattagtaaataaaattgcctatggcaggattctttcttgaattaatattaatccttaaattgatttttctgggattatacaaattcctttttatataaaagtatattgtttaaaacagtagctatagccattaaccaaaggacagatgatatatatatatatgatatatatatatatataagttcttttttagctgtacctacgtacttatatcagcaccatgtatgtaggtgtgatagtactttcaaacagcgcctccacctggcctactctgttatttccacctgtttgggtagggccatttaacttccattatgccaaacttgggatgggattttcgaagcagacaacactatttcatcgtgtttcaaattggaaccttgaggctagttagtatcacactcaggccacactcagcacttgcccactcttgtttactgccttgtattctagttatttgtgtatttgtctccctcactagattatacgctccttgtgggcagggactgtgtcttttttcatctttgtatctttcatgcacctagcatagtgctttgcacatagtagtcactcagtgtttgttaaataaagctattagtgtcattaaaattcaaaa

SEQ ID NO: 125641 - DNA, 2255 bp, Homo sapiens
  Payload ID: 4627
  Gene Symbol: DHX40
  Gene Name: DEAH (Asp-Glu-Ala-His) box polypeptide 40
  Uniprot ID: Q8IX18
  ENST ID: ENST00000425628
  CDS Start-End: 61-2169
ctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttgtgagttactttttcagatggcagagtctgttgattatgattatgatgttcaagataccaccctcgatggcttgttaatattgccgtgttatggatcaatgacaacagatcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggtttccctatttggatccacctaatgagagacttattttagaagctcttaaacaactttaccagtgtgatgctattgacaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaacagcaaagtgatttcccaaaagagacctttgaaggccctaaacatgaagtactacgaagatgtctttgtgcgggctatttcaaaaatgtagctcgaagatctgttgggagaacgttttgcacaatggatggtcgtggaagcccagttcacattcatccttcctcagcacttcatgaacaggaaaccaaacttgaatggatcatttttcatgaggtattggttaccaccaaagtctacgcaagaattgtatgcccaatccgttatgaatgggtaagagacttgttacccaagttgcatgaatttaatgcacatgatttgagcagtgtggcccgacgtgaagtgagagaagatgcaagaaggagatggacaaataaggaaaatgtaaagcagctaaaggatggaatatcgaaagacgtcttaaagaaaatgcaaagaagaaatgatgacaaatccatatctgatgcacgggctcgtttccttgagagaaagcagcagaggacccaggaccacagtgacacacgaaaggaaacaggctaaggtggtgaaccctccaattcaggaagtgggaaaaggagccaggaaatgtgcttctactttgccagttatttcagacagcactacca

SEQ ID NO: 125642 - DNA, 750 bp, Homo sapiens
  Payload ID: 4627
  Gene Symbol: DHX40
  Gene Name: DEAH (Asp-Glu-Ala-His) box polypeptide 40
  ENST ID: ENST00000538926
  CDS Start-End: 1-750
atcaacagaggaggatatttttgccaccaccacctggaattagaaaatgtgtcatatccaccaatatttctgcaacgtctttgacaatagatggaatcagatatgtggtagatggtggcttcgtgaagcagttaaatcacaaccccagattagggttggacatcctggaggtggttccaatttcaaagagcgaggcattacagcgaagtggccgagctggcaggacttcttcaggaaaatgctttcggatctatagtaaagatttttggaaccagtgtatgcctgaccatgtgatccctgaaattaagagaactagtttgacatctgtagttctgaccttaaagtgccttgccatacacgatgtcataaggagtggccatgtcaccagattgggtttgtctatggtggagtttcctttgcctccacatctgacatgtgcagtaataaaagctgcttccctggattgtgaagatctactacttccaatagcagcaatgttgtctgtggaaaacgtcttcattagacctgttgatccagagtaccagaaggaagcagaacagagacatcgagaattggcagctaaagctggaggatttaatgactttgcaactttagctgtcatctttgaacaatgcaaatcaagtggagctccagcttcatggtgccaaaaacactggattcattggaggtgcttattttctgcatttcgtgtggaagctcaacttcgagaactaatcaggaagcttaaac

SEQ ID NO: 125643 - DNA, 539 bp, Homo sapiens
  Payload ID: 4627
  Gene Symbol: DHX40
  Gene Name: DEAH (Asp-Glu-Ala-His) box polypeptide 40
  ENST ID: ENST00000577596
  CDS Start-End: 62-277
tctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggagacagcaatcaaatatatgactgatggatgtttactgaaacatattctgggagacccaaatcttaccaaattcagtgtcattattttggatgaagcccatgaaagaactctaactacagatatcttatttggttt

SEQ ID NO: 125644 - DNA, 855 bp, Homo sapiens
  Payload ID: 4627
  Gene Symbol: DHX40
  Gene Name: DEAH (Asp-Glu-Ala-His) box polypeptide 40
  ENST ID: ENST00000580030
  CDS Start-End: 50-855
catctcctcagatcggtggacgtgctcgcctccactcggggccaggtctatgtcccggtttcccgcagtcgcgggcagggcgccaaggcggcaggaggaggaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcagggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggccagtttgaaatagaaaaaagttg

SEQ ID NO: 125645 - DNA, 814 bp, Homo sapiens
  Payload ID: 4627
  Gene Symbol: DHX40
  Gene Name: DEAH (Asp-Glu-Ala-His) box polypeptide 40
  ENST ID: ENST00000580218
  CDS Start-End: 115-420
acaagtcgcacgcgcggaagtaaacacctctacgtcatcagggcgcgtcctcgtctttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagaagagaaaggatgcacgtcccaggagggaggaactactccaacttttcctattcagaaacaaagaaaaaagattattcaagctgtgagggacaattcattccttattgttactggaaatacaggaagtggtaaaacaactcaactcccaaaatatctatatgaagcaggagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttggaaattgtccaatatttgatatacctggaaggctttatccagtcagagagaaattctgcaatttgattggtccacgagacagagaaaatactgcgtatattcaagcgattgtgaaagtcaccatggatatccatttgaatgaaatggctggagacatcttggtttttctgactggtgag

SEQ ID NO: 125646 - DNA, 580 bp, Homo sapiens
  Payload ID: 4627
  Gene Symbol: DHX40
  Gene Name: DEAH (Asp-Glu-Ala-His) box polypeptide 40
  ENST ID: ENST00000584385
  CDS Start-End: 60-580
tttcccctcccatctcctcagatcggtggacgtgctcgcctccactcggggccaggtctatgtcccggtttcccgcagtcgcgggcagggcgccaaggcggcaggaggagggtgagcggtcaagagacctccaggaagagcggctctcggctgtttgcatcgccgatagagggttttcacaacatggtatgattggtgtaactcaaccacgaaaagtagctgctatatcagttgctcagagagtagctgaagaaatgaaatgcactttgggatccaaagtaggataccaagttcgttttgatgattgcagttctaaggagacagcaatcaaatatatgactgatggatgtttactgaaacatattctgggagacccaaatcttaccaaattcagtgtcattattttggatgaagcccatgaaagaactctaactacagatatcttatttggtttattgaagaagctatttcaggagaagtctcctaataggaaggagcatttaaaagtggtggtaatgtcagcaactatggaattagccaagctctctgcattctttggaaattgtccaatatttgatat

SEQ ID NO: 125647 - DNA, 5558 bp, Homo sapiens
  Payload ID: 4628
  Gene Symbol: DHX8
  Gene Name: DEAH (Asp-Glu-Ala-His) box polypeptide 8
  Uniprot ID: Q14562
  ENST ID: ENST00000262415
  CDS Start-End: 73-3735
gaaagctggaacccggccggagtagctctgagcgccggctgtgaggaaggaggttctgggcaagctatagccatggctgtggctgtagccatggcgggagccttaatcgggtcggagccaggccccgcggaagaacttgccaaactcgagtacctgtctttggtgtcaaaggtttgcactgagctggacaatcacttggggatcaacgacaaggaccttgctgaatttgtgatcagtcttgctgagaaaaataccacctttgatacttttaaggcttctctcgtcaaaaatggtgcagaatttacggattctcttattagtaacttgctgcgtctcatacaaaccatgcggcctccagcgaagccttccactagcaaagatccagttgttaaacctaaaacagaaaaagaaaagctgaaggaactcttcccagtcctttgccaaccggacaacccttctgttcggaccatgttggatgaagatgatgtgaaagttgctgtggatgtcctgaaagaactggaagctttaatgcccagcgcagcaggccaggagaagcaaagagatgctgaacaccgggacaggacaaagaagaagaagcggagtcgaagccgagatcgaaaccgagatcgagacagagatagggaacgaaaccgagatagagaccacaagcggagacaccgatcccgctctcgatcacgttccaggacccgggagaggaataaagtgaagtctagatatcggtccaggagcaggagtcagagtccccccaaagaccggaaggaccgggacaaatatggagagcggaatctggatagatggcgggataagcatgtggaccgccctcctccagaagagcccaccattggtgacatttataatggcaaagttaccagcatcatgcagtttggttgctttgtgcagctggaaggactaaggaagcggtgggaaggcctggtgcacatctctgagctccggcgggagggtcgtgtggccaatgtagctgatgtcgtgagcaaaggccagagggtcaaagtcaaagtgctgtccttcactgggaccaagaccagcctgagcatgaaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacagatgattgctgccaatgtcctttccaaagaagaatttccagactttgatgaagagactggcattctccctaaggtggatgatgaagaagatgaggaccttgagattgaattggttgaggaagagcctccattcctgagagggcacactaagcaaagcatggacatgagccccattaaaattgtcaagaacccagacggctccctctcccaagcagcaatgatgcagagtgccttggccaaagaaaggcgggaactcaaacaggcccagcgggaagctgagatggattctattcccatgggactcaacaaacactgggttgaccctctgcctgatgcggaaggcagacagattgctgccaacatgaggggtattgggatgatgcccaatgatattcctgagtggaagaagcatgcctttgggggcaacaaagcctcttacggaaaaaagacccagatgtcaatccttgagcagagggagagcctgcccatctacaaactgaaggagcaattggtccaggccgtccatgacaatcagatcctgattgtcattggtgagacaggatctggaaagacaacacagatcacccagtacctggcggaggcaggctacacttccaggggcaagattgggtgtacccagcccagaagagtggcagctatgtcggtggccaaaagagtgtcagaggagtttggttgttgcttaggccaagaggtgggctacaccattcgatttgaggactgcactagccctgaaacagtcatcaagtacatgacagatgggatgttgcttagagagtgcttgattgaccctgacctcactcagtacgcgatcatcatgttggacgaggcacatgagaggacaattcacactgatgtgctctttggattgttgaaaaagacagttcagaaacggcaggacatgaagctgattgtcacctcagccaccttggatgcagtgaagttttctcaatacttctatgaagctcccattttcaccatcccaggtcgaacatatccagtggaaatactgtacacaaaggaacctgagacagattatctggatgccagcctgattactgttatgcagattcatttaacagaaccaccaggtgatatcctggtcttcctgactggtcaggaagaaattgatactgcttgtgagatcctgtatgaaagaatgaaatccctgggacctgatgttccagagttaattatcctcccagtgtactctgctcttcccagtgagatgcagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaaggaaacaaaaatggttttctgtgactgttttcttttagccgaaaggttaggatattggcctgggctcagggtgagggagatttagtatctgtgctctggcacacatgatgagaatcccctgaatcccctgaaaccagaacgcagggcctctttgcgctcggaaacgacgtacaacccagacttccagccttgtctttcagcatcagcactagccgggccgtgctgggggatcacccgatgatcaaccatgtcctctccacagagcacttcagtctggaggcctgagtggctacagatggcacatattaaatacagaaggtttccccttgctccctccacctcccacattcgcaatgtgcagcatgtcccatttccttttgaaacatactaagtaacaacacagcttttattttattttgtttttatttttttcccctgaggtcctggatggactttaacaaagggattttatggtcaaaacctccctttccccactccaaacagaaaacaaacataacacctctcctctcagctggtttgtgctgccagtatctgtgctgcagggcttgttcttagtggttttttcctagcacttgcttggagaatagccacctccttgtgccctcctcacagctcctgaggagggttttttttttttcttcccatagagatgggttcccactgtgctgcccaggctgctctccaatccctggcgtcaagcaatcctcctgcctctgcctcccaaagcgctgggattacagttgagagccactgtcctctgcactgaggaggctccttacctggcggaacatcaggcaggtcttgccaggccaggtttcggaacttacggaaagctggtctggatgtagtgcttgtagagaagcttctgagagattgggcacatcctgttacgttgctgcttctcctgtccttatgttattagtaagttctgaagtgatgtaaatgctagaactactgtagaactgtatgccagacactaagagagactatgtaacattccaggatataaaggaatgtatgttgtcactgggcagcaaaccacaccctaaagacaattcagaaagagtccgagggagaggaatataggccaggcaatctgctggctgcagatccctgccccttcattaagctgagtgcctcctgattctgtctgagtattcgcctttgtaagcccaggccagtaatcaaggggcagggcattgttgtgtgttaaccttgaaggccttctggggagagacagtacagggacctcaaatgaaaccaaaggggaaacggggactgggcacccacctccccaatctcgttttgtttttgtttttgttaagacaggatcttgcca

SEQ ID NO: 125648 - DNA, 3809 bp, Homo sapiens
  Payload ID: 4628
  Gene Symbol: DHX8
  Gene Name: DEAH (Asp-Glu-Ala-His) box polypeptide 8
  ENST ID: ENST00000540306
  CDS Start-End: 76-3621
agtgaaagctggaacccggccggagtagctctgagcgccggctgtgaggaaggaggttctgggcaagctatagccatggctgtggctgtagccatggcgggagccttaatcgggtcggagccaggccccgcggaagaacttgccaaactcgagtacctgtctttggtgtcaaaggtttgcactgagctggacaatcacttggggatcaacgacaaggaccttgctgaatttgtgatcagtcttgctgagaaaaataccacctttgatacttttaaggcttctctcgtcaaaaatggtgcagaatttacggattctcttattagtaacttgctgcgtctcatacaaaccatgcggcctccagcgaagccttccactagcaaagatccagttgttaaacctaaaacagaaaaagaaaagctgaaggaactcttcccagtcctttgccaaccggacaacccttctgttcggaccatgttggatgaagatgatgtgaaagttgctgtggatgtcctgaaagaactggaagctttaatgcccagcgcagcaggccaggagaagcaaagagatgctgaacaccgggacaggacaaagaagaagaagcggagtcgaagccgagatcgaaaccgagatcgagacagagatagggaacgaaaccgagatagagaccacaagcggagacaccgatcccgctctcgatcacgttccaggacccgggagaggaataaagtgaagtctagatatcggtccaggagcaggagtcagagtccccccaaagaccggaaggaccgggacaaatatggagagcggaatctggatagatggcgggataagcatgtggaccgccctcctccagaagagcccaccattggtgacatttataatggcaaagttaccagcatcatgcagtttggttgctttgtgcagctggaaggactaaggaagcggtgggaaggcctggtgcacatctctgagctccggcgggagggtcgtgtggccaatgtagctgatgtcgtgagcaaaggccagagggtcaaagtcaaagtgctgtccttcactgggaccaagaccagcctgagcatgaaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacagatgattgctgccaatgtcctttccaaagaagaatttccagactttgatgaagagactggcattctccctaaggtggatgatgaagaagatgaggaccttgagattgaattggttgaggaagagcctccattcctgagagggcacactaagcaaagcatggacatgagccccattaaaattgtcaagaacccagacggctccctctcccaagcagcaatgatgcagagtgccttggccaaagaaaggcgggaactcaaacaggcccagcgggaagctgagatggattctattcccatgggactcaacaaacactgggttgaccctctgcctgatgcggaaggcagacagattgctgccaacatgaggggtattgggatgatgcccaatgatattcctgagtggaagaagcatgcctttgggggcaacaaagcctcttacggaaaaaagacccagatgtcaatccttgagcagagggagagcctgcccatctacaaactgaaggagcaattggtccaggccgtccatgacaatcagatcctgattgtcattggtgagacaggatctggaaagacaacacagatcacccagtacctggcggaggcaggctacacttccaggggcaagattgggtgtacccagcccagaagagtggcagctatgtcggtggccaaaagagtgtcagaggagtttggttgttgcttaggccaagaggtgggctacaccattcgatttgaggactgcactagccctgaaacagtcatcaagtacatgacagatgggatgttgcttagagagtgcttgattgaccctgacctcactcagtacgcgatcatcatgttggacgaggcacatgagaggacaattcacactgatgtgctctttggattgttgaaaaagacagttcagaaacggcaggacatgaagctgattgtcacctcagccaccttggatgcagtgaagttttctcaatacttctatgaagctcccattttcaccatcccaggtcgaacatatccagtggaaatactgtacacaaaggaacctgagacagattatctggatgccagcctgattactgttatgcagattcatttaacagaaccaccaggtgatatcctggtcttcctgactggtcaggaagaaattgatactgcttgtgagatcctgtatgaaagaatgaaatccctgggacctgatgttccagagttaattatcctcccagtgtactctgctcttcccagtgagatgcagacccgaatctttgacccagctccaccaggcagcagaaaggttgtgattgccaccaatatcgcagagacatcgctgactattgatggtatctactatgtggtggacccaggattcgtgaaacagaaagtttacaattccaagacagggattgaccagctcgtggtgacgcctatttctcaggctcaggcaaagcaacgagctggcagagctgggagaacaggcccagggaagtgttacaggttgtacacagaacgtgcctaccgagatgaaatgctgaccaccaacgtgccggaaatccagagaaccaacttagcaagcacagtgctgtcactcaaggccatgggtatcaatgatctgctgtcctttgatttcatggatgccccacctatggaaactttgatcacagccatggagcagctgtacacactgggggccctggatgacgagggcctgctcactcgcttgggccgccggatggcagagttccctctggagccaatgctatgcaaaatgctcatcatgtctgtgcatctgggctgcagtgaggaaatgctgaccattgtatccatgctgtctgtgcagaacgtcttctataggcccaaggataaacaagcccttgcagatcagaagaaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgcccaaagcacttcctccctgtggttgctgtagctgtctcattggagcagtgcctctccaagtttgaggatttgaacaaagaactgggactggtgacttgttaatgaacagttcagagggcagagggccatcatctcagcttgtggagacctttctttccctggatgctgcttctcagctaactccctctctcttcgtgtgtgtactcggccttcagggtttccaccgatttttacaccttcttcccaccacgatagcttggctttaatgtggaattaaattatatattttt

SEQ ID NO: 125649 - DNA, 492 bp, Homo sapiens
  Payload ID: 4628
  Gene Symbol: DHX8
  Gene Name: DEAH (Asp-Glu-Ala-His) box polypeptide 8
  ENST ID: ENST00000587574
  CDS Start-End: 1-100
ttaccggacactgatcgaccagcaggtggtctatatccatccttccagtgccctcttcaacagacagccagaatggaccgtccctatggggcatgtgtgagctccgcagctgggtcaggctcctcggtccaggtttacttcatcccgcctggacgtgatttggctttgactgtctctcctgcagcccaaagcacttcctccctgtggttgctgtagctgtctcattggagcagtgcctctccaagtttgaggatttgaacaaagaactgggactggtgacttgttaatgaacagttcagagggcagagggccatcatctcagcttgtggagacctttctttccctggatgctgcttctcagctaactccctctctcttcgtgtgtgtactcggccttcagggtttccaccgatttttacaccttcttcccaccacgatagcttggctttaatgtggaattaaattatatatttttaaaacctgtttttaaaa

SEQ ID NO: 125650 - DNA, 739 bp, Homo sapiens
  Payload ID: 4628
  Gene Symbol: DHX8
  Gene Name: DEAH (Asp-Glu-Ala-His) box polypeptide 8
  ENST ID: ENST00000589898
  CDS Start-End: 1-417
aaggccaaattccaccagactgaaggggaccacctcaccctgctagctgtgtacaactcctggaagaacaacaagttctccaacccatggtgctatgagaactttatccaggctcgttccctgcgccgggcccaggacattcgcaagcagatgttaggcataatggacagacacaagctggatgttgtttcctgtggcaagtccacagtccgagtgcagaaggccatctgcagtgggttcttccgtaatgctgccaagaaagacccgcaggagggttaccggacactgatcgaccagcaggtggtctatatccatccttccagtgccctcttcaacagacagccagaatgggacctctactcacggttttctgaatggaaatcaggaacaaactgctcatcactgtctggtacctgagctgcagagagaagtcagagccccaccagcgacaccctcaggccccaccaaaacgcactgaagaatccaaccaggaaacctcctgaacacaccacttccccatcagacccagccacggacccagccacggaccccaccccagccagctcacagctaactccccagcacacaggaaggggggaatttgcctggaggcagaggtattcaagcgggatggaagagggaggaacacttgctattagaattacaatcaaggctatttggggagggagccctgggctctctgtgccaaaggactgccgaaaagaattatttaaacttt

SEQ ID NO: 125651 - DNA, 590 bp, Homo sapiens
  Payload ID: 4628
  Gene Symbol: DHX8
  Gene Name: DEAH (Asp-Glu-Ala-His) box polypeptide 8
  ENST ID: ENST00000592258
  CDS Start-End: 174-335
acttcctgtttgatctctatgatccatcctgttgggacttgattcgttcctcaaattttcaatttaccgtaaacaaaggggacgcgcgctgacccggaagtgaaagctggaacccggccggagtagctctgagcgccggctgtgaggaaggaggttctgggcaagctatagccatggctgtggctgtagccatggcgggagccttaatcgggtcggagccaggccccgcggaagaacttgccaaactcgagtacctgtctttggtgtcaaaggtttgcactgagctggacaatcacttggggatcaacgacaaggaccttggattctcttattagtaacttgctgcgtctcatacaaaccatgcggcctccagcgaagccttccactagcaaagatccagttgttaaacctaaaacagaaaaagaaaagctgaaggaactcttcccagtcctttgccaaccggacaacccttctgttcggaccatgttggatgaagatgatgtgaaagttgctgtggatgtcctgaaagaactggaagctttaatgcccagcgcagcaggccaggagaagcaaagagatgctgaacaccg

SEQ ID NO: 125652 - DNA, 2540 bp, Homo sapiens
  Payload ID: 4629
  Gene Symbol: DQX1
  Gene Name: DEAQ box RNA-dependent ATPase 1
  Uniprot ID: Q8TE96
  ENST ID: ENST00000393951
  CDS Start-End: 72-2225
gactacgtgggtctggagctgactgccgtcctgacacgtcctagagctgcaagtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgttgaggccaatcagcaagtgtcaggcagaggcaagacgattgcgagcaagagggttcccaccaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 125653 - DNA, 2689 bp, Homo sapiens
  Payload ID: 4629
  Gene Symbol: DQX1
  Gene Name: DEAQ box RNA-dependent ATPase 1
  Uniprot ID: Q8TE96
  ENST ID: ENST00000404568
  CDS Start-End: 221-2374
gttttccataggttcctgactaggttaaataaggtggagcaaatagccccaccccaaaagcaggcttcaggatttgaagtttgagcccatccctgaggtagagccggaatttacctttgtacttcacacggtcagggttggtggtgactacgtgggtctggagctgactgccgtcctgacacgtcctagagctgcaagcaggtcctgccagagagccaccatgacctctcagcctctcaggctagcagaagagtatggcccaagtcctggggagtctgaactggctgtgaacccctttgatgggcttcccttctcttcccgctactatgagctgctgaagcagcgccaagccttgcccatctgggctgctcgctttaccttcttggagcagttggagagtaaccccactggagtggtgctggtgtctggggagcctggttctggcaagagcacccagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgggacaccatcccacctgatcgggtggaagctgcctgccaagcagtgcttgaattgtgtcggaaggagcttccaggagatgtgctagtgttcctgcccagtgaggaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgttgaggccaatcagcaagtgtcaggcagaggcaagacgattgcgagcaagagggttcccaccaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 125654 - DNA, 1688 bp, Homo sapiens
  Payload ID: 4629
  Gene Symbol: DQX1
  Gene Name: DEAQ box RNA-dependent ATPase 1
  ENST ID: ENST00000418139
  CDS Start-End: 1-399
gaggaaatttccctgtgctgtgaatccttgtccagggaggtagagtccttgcttctccaagggcttccaccacgagtactgccccttcacccagactgtggacgagccgttcaggctgtgtatgaggacatggatgcccgaaaggttgtggtcactcactggctggctgacttctccttctccctcccttccatccaacatgtcatcgactcaggactggagctccgaagtgtttacaatcctaggatccgagcagaattccaagtgttgaggccaatcagcaagtgtcaggcagaggcaagacgattgcgagcaagagggttcccaccagtggtcttctttcccaggtctttttcccctcaggatcctgcctctgcctgtatcctaagtccttcttagaactagaagctccaccattgccacaacccagggtgtgtgaggagaatctgagctccctggtgttactactaaaaaggagacagattgcagagccaggggagtgtcacttcctggaccagcctgctccagaagcactgatgcaagccctggaagatttagactatctggcagccctggatgatgatggggacctgtcagatctgggtgtcatactatcagaattccctctggcccctgagctggccaaagccctgctggcctcatgcgagtttgactgtgtggacgagatgctcaccctggctgccatgctcacagctgcccctgggtttacccgtcctccactcagtgcagaagaagctgccctgcgtcgggccctggaacacacggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgccaa

SEQ ID NO: 125655 - DNA, 555 bp, Homo sapiens
  Payload ID: 4629
  Gene Symbol: DQX1
  Gene Name: DEAQ box RNA-dependent ATPase 1
  ENST ID: ENST00000451518
  CDS Start-End: 199-555
acttcacacggtcagggttggtggtgactacgtgggtctggagctgactgccgtcctgacacgtcctagagctgcaagcagatccctcagtggtgtgcagagtttgcgctggccagagggttccagaaaggacaggttactgttactcagccctaccctcttgcagcccggagcctggctctgcgggttgctgatgagatggacctgaccctgggtcatgaggttggatacagcatcccccaggaggactgcacggggcccaacaccctgctcaggttctgctgggacaggctgcttctgcaggaggtggcctcgacccgaggcactggagcctggggcgtgctggtactagatgaggctcaggagcggtcggtggcatcagattcactccaggggctactgcaagatgccaggctggaaaaacttccgggggacctcagagtggttgtggttactgacccagcccttgaacctaagctccgagctttctggggcaatcctcctattgtgcatatacccagagagcctggtgagagaccttcccccatctactgg

SEQ ID NO: 125656 - DNA, 1649 bp, Homo sapiens
  Payload ID: 4630
  Gene Symbol: DAP3
  Gene Name: death associated protein 3
  Uniprot ID: P51398
  ENST ID: ENST00000343043
  CDS Start-End: 169-1365
ccttttttgcagtctcaggacgggcgctttggagccggccccaggcagcgtgtgtcggtcgcctagtctggagaactagtcctcgactcacggtgagggaatggaccgacacgggtattgtaccgctgagggaaaggagcgggactccggacctccaggagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttct

SEQ ID NO: 125657 - DNA, 2089 bp, Homo sapiens
  Payload ID: 4630
  Gene Symbol: DAP3
  Gene Name: death associated protein 3
  Uniprot ID: P51398
  ENST ID: ENST00000368336
  CDS Start-End: 125-1321
gtcgtttcctgccggatgacccgacccttttttgcagtctcaggacgggcgctttggagccggccccaggcagcgtgtgtcggtcgcctagtctggagaactagtcctcgactcacgtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataataaa

SEQ ID NO: 125658 - DNA, 1470 bp, Homo sapiens
  Payload ID: 4630
  Gene Symbol: DAP3
  Gene Name: death associated protein 3
  Uniprot ID: P51398
  ENST ID: ENST00000421487
  CDS Start-End: 92-1186
gcagtctcaggacgggcgctttggagccggccccaggcagcgtgtgtcggtcgcctagtctggagaactagtcctcgactcacgtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttct

SEQ ID NO: 125659 - DNA, 1894 bp, Homo sapiens
  Payload ID: 4630
  Gene Symbol: DAP3
  Gene Name: death associated protein 3
  Uniprot ID: P51398
  ENST ID: ENST00000535183
  CDS Start-End: 92-1165
gcagtctcaggacgggcgctttggagccggccccaggcagcgtgtgtcggtcgcctagtctggagaactagtcctcgactcacgtgcaaggatgatgctgaaaggaataacaaggcttatctctaggatccataaggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctc

SEQ ID NO: 125660 - DNA, 550 bp, Homo sapiens
  Payload ID: 4630
  Gene Symbol: DAP3
  Gene Name: death associated protein 3
  ENST ID: ENST00000463575
  CDS Start-End: 8-550
tgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagggcataacacgggtgaggaacgccacagatgcagttggaattgtgctgaaagagctaaagaggcaaagttctttgggtatgttt

SEQ ID NO: 125661 - DNA, 816 bp, Homo sapiens
  Payload ID: 4630
  Gene Symbol: DAP3
  Gene Name: death associated protein 3
  ENST ID: ENST00000477394
  CDS Start-End: 1-632
aagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaagggttttaccacatggcccaggctcgtctggaactcctgggctcaagcaatatgcccatctcagcctcccaaggtgctgggattacaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataag

SEQ ID NO: 125662 - DNA, 1671 bp, Homo sapiens
  Payload ID: 4630
  Gene Symbol: DAP3
  Gene Name: death associated protein 3
  Uniprot ID: P51398
  ENST ID: ENST00000471642
  CDS Start-End: 314-1387
cagaggtccaggtccgggagatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcggtctcaggacgggcgctttggagccggccccaggcagcgtgtgtcggtcgcctagtctggagaactagtcctcgactcacgtgcaaggatgatgctgaaaggaataacaaggcttatctctaggatccataaggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttct

SEQ ID NO: 125663 - DNA, 682 bp, Homo sapiens
  Payload ID: 4630
  Gene Symbol: DAP3
  Gene Name: death associated protein 3
  ENST ID: ENST00000475056
  CDS Start-End: 1-348
ggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaa

SEQ ID NO: 125664 - DNA, 556 bp, Homo sapiens
  Payload ID: 4630
  Gene Symbol: DAP3
  Gene Name: death associated protein 3
  ENST ID: ENST00000491777
  CDS Start-End: 1-138
gaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataataaa

SEQ ID NO: 125665 - DNA, 439 bp, Homo sapiens
  Payload ID: 4630
  Gene Symbol: DAP3
  Gene Name: death associated protein 3
  ENST ID: ENST00000470830
  CDS Start-End: 81-439
acgggcgctttggagccggccccaggcagcgtgtgtcggtcgcctagtctggagaactagtcctcgactcacgtgcaaggatgatgctgaaaggaataacaaggcttatctctaggatccataaggccaagcatggggatcagcacgagggtcagcactacaacatctccccccaggatttggagactgtatttccccatggccttcctcctcgctttgtgatgcaggtgaagacattcagtgaagcttgcctgatggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgt

SEQ ID NO: 125666 - DNA, 807 bp, Homo sapiens
  Payload ID: 4630
  Gene Symbol: DAP3
  Gene Name: death associated protein 3
  ENST ID: ENST00000497826
  CDS Start-End: 8-807
tgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgcc

SEQ ID NO: 125667 - DNA, 729 bp, Homo sapiens
  Payload ID: 4630
  Gene Symbol: DAP3
  Gene Name: death associated protein 3
  ENST ID: ENST00000465375
  CDS Start-End: 89-430
gtctcaggacgggcgctttggagccggccccaggcagcgtgtgtcggtcgcctagtctggagaactagtcctcgactcacgtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgctcaagacagggaatggaattggagggagcccagaatacaagctgctgctagcaaaggggtggggctaaatgagaagaaaatttaaaaagatgaaatttaatctgaaaaacagaaattcatgtgttgattaccttttgtgactagtacaattactttaagctcatgtttaaacaatattgatgttttcctccttgtatagcccaagaagattccagtaatttcagcatcaaataactgttttaaatgaacttaaaatttgccttggcaaaatatcatgaaaatagttaatatgctgcacaaaagcaaaatcatagtacactcctgagctaaatagaagcaatattttgattagatgcattggttttta

SEQ ID NO: 125668 - DNA, 1287 bp, Homo sapiens
  Payload ID: 4630
  Gene Symbol: DAP3
  Gene Name: death associated protein 3
  ENST ID: ENST00000471214
  CDS Start-End: 389-1287
agatgacagtggctcccagaaagcccaggattcaatcgctgagagagtgcttaggcccgaatgccggcccaaatcgttctactcaccgtgtcggaggccgagagcgatgagagtacagggaagtgaggaagagggggtggccgccaggctcctccgcttccctgggtccaccgcggatccctcccgcttgtcaggaggcggccagcggtctcaggacgggcgctttggagccggccccaggcagcgtgtgtcggtcgcctagtctggagaactagtcctcgactcacgagatgaagttttaccatgttggccaggctggtctcgaattcctgacctcaagtgatctgcccaccttgacctcccaaagtgctgggattacagtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatga

SEQ ID NO: 125669 - DNA, 384 bp, Homo sapiens
  Payload ID: 4630
  Gene Symbol: DAP3
  Gene Name: death associated protein 3
  ENST ID: ENST00000608852
  CDS Start-End: 1-198
aggcttatctctaggatccataaggccaagcatggggatcagcacgagggtcagcactacaacatctccccccaggatttggagactgtatttccccatggccttcctcctcgctttgtgatgcaggtgctcaagacagggaatggaattggagggagcccagaatacaagctgctgctagcaaaggggtggggctaaatgagaagaaaatttaaaaagatgaaatttaatctgaaaaacagaaattcatgtgttgattaccttttgtgactagtacaattactttaagctcatgtttaaacaatattgatgttttcctccttgtatagcccaagaagattccagtaatttcagcatcaaataactgttttaaatgaacttaaa

SEQ ID NO: 125670 - DNA, 710 bp, Homo sapiens
  Payload ID: 4630
  Gene Symbol: DAP3
  Gene Name: death associated protein 3
  ENST ID: ENST00000490249
  CDS Start-End: 1-423
ggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattgggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaa

SEQ ID NO: 125671 - DNA, 725 bp, Homo sapiens
  Payload ID: 4630
  Gene Symbol: DAP3
  Gene Name: death associated protein 3
  ENST ID: ENST00000479151
  CDS Start-End: 1-725
acgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaag

SEQ ID NO: 125672 - DNA, 607 bp, Homo sapiens
  Payload ID: 4630
  Gene Symbol: DAP3
  Gene Name: death associated protein 3
  ENST ID: ENST00000463295
  CDS Start-End: 1-320
ctctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaa

SEQ ID NO: 125673 - DNA, 552 bp, Homo sapiens
  Payload ID: 4631
  Gene Symbol: DAPL1
  Gene Name: death associated protein-like 1
  Uniprot ID: A0PJW8
  ENST ID: ENST00000309950
  CDS Start-End: 57-380
acagctggcattcagcctccagagcaccagcactggcactggcactggcacacgctatggcaaatgaagtgcaagacctgctctcccctcggaaagggggacatcctcctgcagtaaaagctggaggaatgagaatttccaaaaaacaagaaattggcaccttggaaagacataccaaaaaaacaggattcgagaaaacaagtgccattgcaaatgttgccaaaatacagacactggatgccctgaatgacgcactggagaagctcaactataaatttccagcaacagtgcacatggcgcatcaaaaacccacacctgctctggaaaaggttgttccactgaaaaggatctacattattcagcagcctcgaaaatgttaagcctggatttaaaacacagccgtctggccagctgcctcgaatatctgacagcttagcaaaaagggccaaagctttccataggcgtgctgcacttgcttggtaaattaagcagcttttgtatcttcccctttgactttaggtaataaagcatccaaacttgtaaatctgacac

SEQ ID NO: 125674 - DNA, 598 bp, Homo sapiens
  Payload ID: 4631
  Gene Symbol: DAPL1
  Gene Name: death associated protein-like 1
  ENST ID: ENST00000343761
  CDS Start-End: 1-523
gagaatttccaaaaaacaagaaattggcaccttggaaagacataccaaaaaaacaggattcgagaaaacaagtgccattgcaaatgttgccaaaatacagacactggatgccctgaatgacgcactggagaaggaacaagttcagctgggagtgaggaatgaaaggcaggtccagccttttcaccatggttgcagctggaaggaaacaagtggatttgacacaagctcagaggatccagaacggctgttcctgtccatgtgcctggtcacggtgctggggaacctgctcatcatcctggccgtcacccctgactcccacctccacatccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatgtcattcagccatcacgaacccgtgtttctgtggctttctagtttt

SEQ ID NO: 125675 - DNA, 544 bp, Homo sapiens
  Payload ID: 4631
  Gene Symbol: DAPL1
  Gene Name: death associated protein-like 1
  ENST ID: ENST00000409042
  CDS Start-End: 57-398
acagctggcattcagcctccagagcaccagcactggcactggcactggcacacgctatggcaaatgaagtgcaagacctgctctcccctcggaaagggggacatcctcctgcagtaaaagctggaggaatgagaatttccaaaaaacaagaaattggcaccttggaaagacataccaaaaaaacaggattcgagaaaacaagtgccattgcaaatgttgccaaaatacagacactggatgccctgaatgacgcactggagaaggaacaagttcagctgggagtgaggaatgaaaggcaggtccagccttttcaccatggttgcagctggaaggaaacaagtggatttgacacaaggtgtccaagacacacggagccacggaatctcacaggtgtctgagaattcctcctcctgggactctcagaggatccagaactgctgccggtcctcgctttgctgtccctgtccctgtccatgtatctggtcatggtgctgaggaacctgctcagcatcctggctgtcagctctgactcccctccacaccc

SEQ ID NO: 125676 - DNA, 867 bp, Homo sapiens
  Payload ID: 4631
  Gene Symbol: DAPL1
  Gene Name: death associated protein-like 1
  ENST ID: ENST00000619477
  CDS Start-End: 16-615
gcactggcacacgctatggcaaatgaagtgcaagacctgctctcccctcggaaagggggacatcctcctgcagtaaaagctggaggaatgagaatttccaaaaaacaagaaattggcaccttggaaagacataccaaaaaaacaggattcgagaaaacaagtgccattgcaaatgttgccaaaatacagacactggatgccctgaatgacgcactggagaaggaacaagttcagctgggagtgaggaatgaaaggcaggtccagccttttcaccatggttgcagctggaaggaaacaagtggatttgacacaagaagctcagaggatccagaacggctgttcctgtccatgtgcctggtcacggtgctggggaacctgctcatcatcctggccgtcacccctgactcccacctccacatccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatgtcattcagccatcacgaacccgtgtttctgtggctttctagttttgttgtcttttttttttctcagtcttttagacgcccagctgcacaacttgattgccttacaaaggacctgcttcaaggatgtggaaattcctaatttcttctgtgacccttctcaattccccgtcttgcatgttgtggcaccttcaccaataacataatcatgtatttccctgctgcc

SEQ ID NO: 125677 - DNA, 671 bp, Homo sapiens
  Payload ID: 4631
  Gene Symbol: DAPL1
  Gene Name: death associated protein-like 1
  ENST ID: ENST00000621326
  CDS Start-End: 57-461
acagctggcattcagcctccagagcaccagcactggcactggcactggcacacgctatggcaaatgaagtgcaagacctgctctcccctcggaaagggggacatcctcctgcagtaaaagctggaggaatgagaatttccaaaaaacaagaaattggcaccttggaaagacataccaaaaaaacaggattcgagaaaacaagtgccattgcaaatgttgccaaaatacagacactggatgccctgaatgacgcactggagaagagtttcgctctttttgcccaggctggaaagcaatggagcgatctcagctcactgcaacctccacctcccgggttcaagtggttctcctgcctcagcctcccgagtagctgggattacagctcaactataaatttccagcaacagtgcacatggcgcatcaaaaacccacacctgctctggaaaaggttgttccactgaaaaggatctacattattcagcagcctcgaaaatgttaagcctggatttaaaacacagccgtctggccagctgcctcgaatatctgacagcttagcaaaaagggccaaagctttccataggcgtgctgcacttgcttggtaaattaagcagcttttgtatcttcccctttgactttaggtaataaagcatccaaacttgtaaatctgacac

SEQ ID NO: 125678 - DNA, 3203 bp, Homo sapiens
  Payload ID: 4632
  Gene Symbol: DTHD1
  Gene Name: death domain containing 1
  Uniprot ID: Q6ZMT9
  ENST ID: ENST00000357504
  CDS Start-End: 392-2242
atgttgtgagaaagtgctgggctagctgactcggatcatctcctagagtttaggagaaataacaatcacaaagtttgaatttgcaaaacctttaggctttgctggcaggagagaaaataccacttttggatcataaaatggatatggaatacatgggctcaggtaaactgggccaaatattgaagcagatttggagacaaaaccagatgctaaagcaggcactcttgggtgatgacctttgtgagggggctggtggggccacttggatggccactgtggtctttctgggtcaggaactcagcagtgcccttcaccagctgctggagcacacctcaggcaccctgcgttccacctgccagcagctgcatgtgctgcttgacaaagagaatcaatgtgtctcgagaaaaggtatcttgatgtgctgagtgatgttactggcccccaagtgtcttgttatattacagcaccatcatatgttctacaacaactagaatgccggataataaatcacatgagttctttaatagtgggtgataatgaagagttagttagcaacgtcataactattgaatgctcagataaggaaaagagagttccatttccaataggcattgcaattccatttactgcacgttacagaggaaattacagagatatcatggtgaaagtgtgtgacataaaccttcaatcaagttacctaaacccaaattcactagaaggaatgaagggaggttataaggggacctgtgcttcagtaaaagtttacaaattgggtatcttttctgttgtgtcttgtttaaagaaagagtcgttcacagtaacaaagaaaggcctcgctcttaagtcaagcatggattcccgaatatccttaaattaccctccaggagtttttacctctccagtgctggtgcagttaaagatccaaccagttgacccagctctggtggcacatttaaaagcacagcaagatactttctactcagtccaatccacaagccctctgattcacattcagcacccatcaacttatccttttcagaagccagtcactttgtttttaccttgttctccataccttgataaaaacaaccttggttctgagatagatcataaaagaagagcaagtgccacaataaataggattacaccttcgtatttcaaccggacaaaaattgcctccataagaaaacctaggaaaaatgccagtgaatgtttgaaattactgggattcagaagccaagacagtggttggtgtgggcttgatgatgttgtgaaaaccatacagagcggcttggtatcagttgaattgtatgaacatttggagaggtttattgtacttcacctctcttccaccatggacaatagtcatttggttacttttgtgaaatctttagaggaagccatgctcagcaccactgcctgcatagtactgtctcaccagaaggacaatccacatagaatagctgttttagtggtgccttccaaagatttaagccaggtgcttaaggacctgcacttggaagggtttggaggacctccagagccatctcgtcatttccaagttcgagaaggagaacaacttcttttaagatttactggaaacatatttgcttcaagcaacgggaaggattatggaaaagactacacacttatttttcacttgcaaagaaaacctaggctggaactccaaatcaaagaagtggacgaatttggaaactatagttgccctcattacaaaggcaccattgtcgtttataaagtacctaaaggaaagatagtccccaacttgaatcaatctctcgtaattaatgaaaaccattctcagttgccaatttgcaaattaccattgaaattgccaaagcataagaaattaatcaaccgtccacagagtaccaaaagagtttctaaggatcctgtagaagccctttgggataacttgctccattggctggctgaggagctctcagaagaaaatgctgagtctctttcctcaactctccctctgcgccgtagcaccattcagctcatcaaactcaagaaccctgatgatctcacagaacagatccacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactgaaccacagcagtgttttgatgtagcccctgagtaaaagcctgatctctcttcctttacccctaggaaaaggcacacggtgggtttttgtttctgtcaacattttcctggaagtttccgaatgatattatttgaagtcagtctatttaatgatgtgctatttaatgatgtgagacaaagggagaagcacggatcagataatagaaagcattcctgggtgtgagcgctcctctctggttgagtgattatgttttgcaaccatgactgtcttgagtttggcctcacttaatagcatttgcaattgagtttgacttgttcacattttaaaagctaagtgtgaagaaaagatctgatatatgtaattacttattaattggtatctacataaaattaaactagttttctgtgacttcaagtgtgagcccaaaaatatctgagacagttctcaatcaatttagaaagattattttgccaaggttaaggacaggcccgtaacagcctcagaagatcctgatgacatatgcccaaggtgttcggggtagagcttgcttttatgcattttagggagttataatatatcaatcaatacatgtaaggtgtacattggctcaatctggaaaggtaggacaactcaaagcaggggcttccagatcacaggtagatttaaagattcttgattggcattgattgaacagttattatctaaagacctggaatcaataggaaggaaatgcctgggctatgataagaagttatggagaccaaagttttataatgcagatgaagcctccaggtagcagactttagagggaatagattgtaaatatttctgatcagtcctaaggtctgttgaaatttatgctggccagcttttcctgaattccaaaagagaggagggtattatggagtcatgtccaacctccccttcccagcatggcctaaactagtttttcaggataactttgaaatgcccttggctgagagaaggggcttgttca

SEQ ID NO: 125679 - DNA, 3365 bp, Homo sapiens
  Payload ID: 4632
  Gene Symbol: DTHD1
  Gene Name: death domain containing 1
  Uniprot ID: Q6ZMT9
  ENST ID: ENST00000456874
  CDS Start-End: 59-2404
ggggagcactgctgcacttctaaagaaagaagaaaaggagatttgtaatttatgcggcatgcatgatgaatgtactccacagcagacaatgtcctccattcaagataccaaagcagcagacattgctgcaagaggggaactaaatgtcatagaaacagctactgtttctcccacaaatggagaggaaagtcattacacaaaccaggtccagttagaaaaaaataaaacacatatgagttcagcattagtggaaaaagaaaacaatacatcactgaatggacgtgtactggggcaagaagagtcacagaataaaatgttcccagataatgcagaaaatgaagatgataaacaaatagaacacatgactgttgagaacataaatggcaacagggaagagactcatggcataattcagacaacagagacagaaattcaagagacttcagaaagcccaagagaagagatgaccacatcctcaataatatgtgatatctccaagaaatatataaatagtactcttcccaatgattcagagaatataaagcacaagaataacataatggaaaaggagtatcttgatgtgctgagtgatgttactggcccccaagtgtcttgttatattacagcaccatcatatgttctacaacaactagaatgccggataataaatcacatgagttctttaatagtgggtgataatgaagagttagttagcaacgtcataactattgaatgctcagataaggaaaagagagttccatttccaataggcattgcaattccatttactgcacgttacagaggaaattacagagatatcatggtgaaagtgtgtgacataaaccttcaatcaagttacctaaacccaaattcactagaaggaatgaagggaggttataaggggacctgtgcttcagtaaaagtttacaaattgggtatcttttctgttgtgtcttgtttaaagaaagagtcgttcacagtaacaaagaaaggcctcgctcttaagtcaagcatggattcccgaatatccttaaattaccctccaggagtttttacctctccagtgctggtgcagttaaagatccaaccagttgacccagctctggtggcacatttaaaagcacagcaagatactttctactcagtccaatccacaagccctctgattcacattcagcacccatcaacttatccttttcagaagccagtcactttgtttttaccttgttctccataccttgataaaaacaaccttggttctgagatagatcataaaagaagagcaagtgccacaataaataggattacaccttcgtatttcaaccggacaaaaattgcctccataagaaaacctaggaaaaatgccagtgaatgtttgaaattactgggattcagaagccaagacagtggttggtgtgggcttgatgatgttgtgaaaaccatacagagcggcttggtatcagttgaattgtatgaacatttggagaggtttattgtacttcacctctcttccaccatggacaatagtcatttggttacttttgtgaaatctttagaggaagccatgctcagcaccactgcctgcatagtactgtctcaccagaaggacaatccacatagaatagctgttttagtggtgccttccaaagatttaagccaggtgcttaaggacctgcacttggaagggtttggaggacctccagagccatctcgtcatttccaagttcgagaaggagaacaacttcttttaagatttactggaaacatatttgcttcaagcaacgggaaggattatggaaaagactacacacttatttttcacttgcaaagaaaacctaggctggaactccaaatcaaagaagtggacgaatttggaaactatagttgccctcattacaaaggcaccattgtcgtttataaagtacctaaaggaaagatagtccccaacttgaatcaatctctcgtaattaatgaaaaccattctcagttgccaatttgcaaattaccattgaaattgccaaagcataagaaattaatcaaccgtccacagagtaccaaaagagtttctaaggatcctgtagaagccctttgggataacttgctccattggctggctgaggagctctcagaagaaaatgctgagtctctttcctcaactctccctctgcgccgtagcaccattcagctcatcaaactcaagaaccctgatgatctcacagaacagatccacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactgaaccacagcagtgttttgatgtagcccctgagtaaaagcctgatctctcttcctttacccctaggaaaaggcacacggtgggtttttgtttctgtcaacattttcctggaagtttccgaatgatattatttgaagtcagtctatttaatgatgtgctatttaatgatgtgagacaaagggagaagcacggatcagataatagaaagcattcctgggtgtgagcgctcctctctggttgagtgattatgttttgcaaccatgactgtcttgagtttggcctcacttaatagcatttgcaattgagtttgacttgttcacattttaaaagctaagtgtgaagaaaagatctgatatatgtaattacttattaattggtatctacataaaattaaactagttttctgtgacttcaagtgtgagcccaaaaatatctgagacagttctcaatcaatttagaaagattattttgccaaggttaaggacaggcccgtaacagcctcagaagatcctgatgacatatgcccaaggtgttcggggtagagcttgcttttatgcattttagggagttataatatatcaatcaatacatgtaaggtgtacattggctcaatctggaaaggtaggacaactcaaagcaggggcttccagatcacaggtagatttaaagattcttgattggcattgattgaacagttattatctaaagacctggaatcaataggaaggaaatgcctgggctatgataagaagttatggagaccaaagttttataatgcagatgaagcctccaggtagcagactttagagggaatagattgtaaatatttctgatcagtcctaaggtctgttgaaatttatgctggccagcttttcctgaattccaaaagagaggagggtattatggagtcatgtccaacctccccttcccagcatggcctaaactagtttttcaggataactttgaaatgcccttggctgagagaaggggcttgttca

SEQ ID NO: 125680 - DNA, 2606 bp, Homo sapiens
  Payload ID: 4632
  Gene Symbol: DTHD1
  Gene Name: death domain containing 1
  ENST ID: ENST00000507598
  CDS Start-End: 99-2564
ggtctttgtaggtttctaaaattatcttgccatgtttcattagatgtcagtgcagaaacataatttggtttagttttgtatttattctttgtgtgtccatgtatgtgtgtgtagaaatcattactttcatagactgcctcataaaaataactgaacatttggggagcactgctgcacttctaaagaaagaagaaaaggagatttgtaatttatgcggcatgcatgatgaatgtactccacagcagacaatgtcctccattcaagataccaaagcagcagacattgctgcaagaggggaactaaatgtcatagaaacagctactgtttctcccacaaatggagaggaaagtcattacacaaaccaggtccagttagaaaaaaataaaacacatatgagttcagcattagtggaaaaagaaaacaatacatcactgaatggacgtgtactggggcaagaagagtcacagaataaaatgttcccagataatgcagaaaatgaagatgataaacaaatagaacacatgactgttgagaacataaatggcaacagggaagagactcatggcataattcagacaacagagacagaaattcaagagacttcagaaagcccaagagaagagatgaccacatcctcaataatatgtgatatctccaagaaatatataaatagtactcttcccaatgattcagagaatataaagcacaagaataacataatggaaaaggagtatcttgatgtgctgagtgatgttactggcccccaagtgtcttgttatattacagcaccatcatatgttctacaacaactagaatgccggataataaatcacatgagttctttaatagtgggtgataatgaagagttagttagcaacgtcataactattgaatgctcagataaggaaaagagagttccatttccaataggcattgcaattccatttactgcacgttacagaggaaattacagagatatcatggtgaaagtgtgtgacataaaccttcaatcaagttacctaaacccaaattcactagaaggaatgaagggaggttataaggggacctgtgcttcagtaaaagtttacaaattgggtatcttttctgttgtgtcttgtttaaagaaagagtcgttcacagtaacaaagaaaggcctcgctcttaagtcaagcatggattcccgaatatccttaaattaccctccaggagtttttacctctccagtgctggtgcagttaaagatccaaccagttgacccagctctggtggcacatttaaaagcacagcaagatactttctactcagtccaatccacaagccctctgattcacattcagcacccatcaacttatccttttcagaagccagtcactttgtttttaccttgttctccataccttgataaaaacaaccttggttctgagatagatcataaaagaagagcaagtgccacaataaataggattacaccttcgtatttcaaccggacaaaaattgcctccataagaaaacctaggaaaaatgccagtgaatgtttgaaattactgggattcagaagccaagacagtggttggtgtgggcttgatgatgttgtgaaaaccatacagagcggcttggtatcagttgaattgtatgaacatttggagaggtttattgtacttcacctctcttccaccatggacaatagtcatttggttacttttgtgaaatctttagaggaagccatgctcagcaccactgcctgcatagtactgtctcaccagaaggacaatccacatagaatagctgttttagtggtgccttccaaagatttaagccaggtgcttaaggacctgcacttggaagggtttggaggacctccagagccatctcgtcatttccaagttcgagaaggagaacaacttcttttaagatttactggaaacatatttgcttcaagcaacgggaaggattatggaaaagactacacacttatttttcacttgcaaagaaaacctaggctggaactccaaatcaaagaagtggacgaatttggaaactatagttgccctcattacaaaggcaccattgtcgtttataaagtacctaaaggaaagatagtccccaacttgaatcaatctctcgtaattaatgaaaaccattctcagttgccaatttgcaaattaccattgaaattgccaaagcataagaaattaatcaaccgtccacagagtaccaaaagagtttctaaggatcctgtagaagccctttgggataacttgctccattggctggctgaggagctctcagaagaaaatgctgagtctctttcctcaactctccctctgcgccgtagcaccattcagctcatcaaactcaagaaccctgatgatctcacagaacagatccacgagtttctttgcttctggaaaaaatcgcttccaactttcaccgacaaacttcgcctcctggctcgacatctccgcaagattggcaggagtgatcttgcagaagagctcaaattcaagtgggaaaataaagtgttcactgaaccacagcagtgttttgatgtagcccctgagtaaaagcctgatctctcttcctttacccctaggaaaaggcacacg

SEQ ID NO: 125681 - DNA, 1256 bp, Homo sapiens
  Payload ID: 4633
  Gene Symbol: DEDD
  Gene Name: death effector domain containing
  ENST ID: ENST00000368005
  CDS Start-End: 88-1134
gggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtggtgaggaagttcaagggttccagagatggagcagacttgaaggagaatataaagaactgctgggacactgggcagtttatgctattcagtacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgccttttttttttttttttt

SEQ ID NO: 125682 - DNA, 2345 bp, Homo sapiens
  Payload ID: 4633
  Gene Symbol: DEDD
  Gene Name: death effector domain containing
  Uniprot ID: O75618
  ENST ID: ENST00000368006
  CDS Start-End: 216-1172
cacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaattc

SEQ ID NO: 125683 - DNA, 2300 bp, Homo sapiens
  Payload ID: 4633
  Gene Symbol: DEDD
  Gene Name: death effector domain containing
  Uniprot ID: O75618
  ENST ID: ENST00000458050
  CDS Start-End: 174-1130
aggaaagtggagggggaggcggtggcgacgtccagcctgagaacctcaagagagggaggtgacgggacgctgagaggaagagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaa

SEQ ID NO: 125684 - DNA, 2329 bp, Homo sapiens
  Payload ID: 4633
  Gene Symbol: DEDD
  Gene Name: death effector domain containing
  Uniprot ID: O75618
  ENST ID: ENST00000545495
  CDS Start-End: 203-1159
cgcccgcctgtcccctcccccacggccgcggcggcggcggcggcggcggctgctggagcccggatgcggcgccgtgaggcaggcccgggagagcggcgcggatggatccaacatggcggcgccgagcctgagccgagatacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggactctgaagtgtattttgaaaattaatcgccaccctcttccaaattatagaattttttaaaaacaagctgtggccctttccactctctcctggcctctggtgctgctcctctctgccgcctttcctccattccatggcttgaaacctctgcctgatgtggctccttcctttttcccatttgtcaaaccctcttcaaaggaggaacagataagactgggtcagcctagtcatgcctcccaactgtggtggtatatgtgtacacacatacacagggtggatggagaagaggttgctgattaaaatacactccccctataaaggggaagggggagtgtgacactttctttccatgttcaagtgaaaataaataatgtaccctgcagcccttttcccctttgctttcttctggcttgggcaaagggcatcataggtgtaagtgaagtaattcctttttccttccccctcctccactcctacgcccactcccatgcttgggagaatggggctgggacatgcactgagtgttgcacttttatttaggtagggaggcatgttgaatgagccaggaggtctagaactggagcttagtccagctggtacaataccaactccccttctagttcccaaaggcgatgtccagacacagactttatgattattatatttttcaatgccagtgctgctcagccctcagcagaacttcagtttccatgaaataaacaatgactatataaaa

SEQ ID NO: 125685 - DNA, 964 bp, Homo sapiens
  Payload ID: 4633
  Gene Symbol: DEDD
  Gene Name: death effector domain containing
  ENST ID: ENST00000464113
  CDS Start-End: 103-964
gatggatccaacatggcggcgccgagcctgagccgagatacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatg

SEQ ID NO: 125686 - DNA, 1527 bp, Homo sapiens
  Payload ID: 4633
  Gene Symbol: DEDD
  Gene Name: death effector domain containing
  Uniprot ID: O75618
  ENST ID: ENST00000490843
  CDS Start-End: 211-1167
acggccgcggcggcggcggcggcggcggctgctggagcccggatgcggcgccgtgaggcaggcccgggagagcggcgcggatggatccaacatggcggcgccgagcctgagccgagaagacctgggaaattaagtttcttgcggagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctgtgtgccctgatcttgtagacaagtatctggaggagacatcaattcgctatgtgacccccagagccctcagtgatccagaaccaaggcctccccagccctctaaaacagtgcctccccactatcctgtggtgtgttgccccacttcgggtcctcagatgtgtagcaagcggccagcccgagggagagccacacttgggagccagcgaaaacgccggaagtcagtgacaccagatcccaaggagaagcagacatgtgacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttct

SEQ ID NO: 125687 - DNA, 1882 bp, Homo sapiens
  Payload ID: 4634
  Gene Symbol: DEDD2
  Gene Name: death effector domain containing 2
  Uniprot ID: Q8WXF8
  ENST ID: ENST00000336034
  CDS Start-End: 77-1042
gcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaagggcataggtgggca

SEQ ID NO: 125688 - DNA, 1037 bp, Homo sapiens
  Payload ID: 4634
  Gene Symbol: DEDD2
  Gene Name: death effector domain containing 2
  ENST ID: ENST00000598727
  CDS Start-End: 90-704
aaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgatggggaaacaggctcagagaggtaaggtcacatgcccaaggccccacagcttagagagtggcagagctgggactcacctcaaggtctgttggactccgccacctggccctgcctctgtggccaaccactcctgggtggcctggaagaggtgctgctcctcccagccccctgctctcccacccacattgattgaggtcatggccagttgcttactggagtcaaggatgcagtcaaggatctggtcgtctgggtagagacagctgggtctgaatgccatgggagggcctgggggctgaggctgggcaggcttccctgggcgttgggtggagaggatggggttcccctagagccagaaaga

SEQ ID NO: 125689 - DNA, 465 bp, Homo sapiens
  Payload ID: 4634
  Gene Symbol: DEDD2
  Gene Name: death effector domain containing 2
  ENST ID: ENST00000598200
  CDS Start-End: 113-465
aaacaagtggctgcggccgtcgcccaggagtcatcggacgccagaatctggtgaggatccagagaggcctaatggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatgg

SEQ ID NO: 125690 - DNA, 1894 bp, Homo sapiens
  Payload ID: 4634
  Gene Symbol: DEDD2
  Gene Name: death effector domain containing 2
  Uniprot ID: Q8WXF8
  ENST ID: ENST00000595337
  CDS Start-End: 89-1069
tcccgggctaagcgtcggcaagttctgtagagaaactcgggcaacctttggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctagaggactgtcactctagcatctttgaggactgcgacaggaccgggacagcaggccccttgacagcccctcccacaggatgtgggctctgaggcctaaaccatttccagctgagtttccttcccagactcctcctacccccaggtgtgcccccttagcctccggaggcgggggctgggcctgtatctcagaagggaggggcacagctacacactcaccaaaggcccccctgcacattgtatctctgatcttgggctgtctgcactgtcacaggtgcacacactcgctcatgctcacactgcccctgctgagatcttccctgggcctctgccctggcctgcttcccagcacacacttctttggcctaagggcttctctctcaggacctctaatttgaccacaaccaacctgggcttcagccacatcagtgggcactggagctggggtgcacatggggcctgctcaccttgcccacacatctccagccagccagggccctgcccagcttcaatttacagacctgactctcctcaccttcccccctgctgtccagagctgaacatagacttgcacttggatgtcacctggagtgtcacatgggagtgttatggcagcatcataccaaggcctactgttgcacatggggccaaaaccagtaaacagccaccttcttggaaagggaatgcaaaggctttgggggtgatggaaaagaccttttacaaatgataccaattaaactgccctggaaa

SEQ ID NO: 125691 - DNA, 1183 bp, Homo sapiens
  Payload ID: 4634
  Gene Symbol: DEDD2
  Gene Name: death effector domain containing 2
  Uniprot ID: Q8WXF8
  ENST ID: ENST00000596251
  CDS Start-End: 124-1104
aggcgtaataatagagaaggtgccagaaagatccaaaacaagtggctgcggccgtcgcccaggagtcatcggacgccagaatctggccgggttctgagcttgttccgcctccctcccccgggaatggcgctatccgggtcgaccccggccccgtgctgggaggaggatgagtgcctggactactacgggatgctgtcgcttcaccgtatgttcgaggtggtgggcgggcaactgaccgagtgcgagctggagctcctggcctttctgctggatgaggctcctggcgccgccggaggcttagcccgggcccgcagcggcctagagctcctgctggagctggagcgccgcgggcagtgcgacgagagcaacctgcggctgctggggcaactcctgcgcgtgctggcccgccacgacctgctgccgcacctggcgcgcaagcggcgccggccagtgtctccagaacgctatagctatggcacctccagctcttcaaagaggacagagggtagctgccgtcgccgtcggcagtcaagcagttctgcaaattctcagcagggtcagtgggagacaggctcccccccaaccaagcggcagcggcggagtcggggccggcccagtggtggtgccagacggcggcggagaggggccccagccgcaccccagcagcagtcagagcccgccagaccttcctctgaaggcaaagtgacctgtgacatccggctccgggttcgagcagagtactgcgagcatgggccagccttggagcagggcgtggcatcccggcggccccaggcgctggcgcggcagctggacgtgtttgggcaggccaccgcagtgctgcgctcaagggacctgggctctgtggtttgtgacatcaagttctcagagctctcctatctggacgccttctggggcgactacctgagtggcgccctgctgcaggccctgcggggcgtgttcctgactgaggccctgcgagaggctgtgggccgggaggctgttcgcctgctggtcagtgtggatgaggctgactatgaggctggccggcgccgcctgttgctgatggaggaggaaggggggcggcgcccgacagaggcctcctgatccaggactggcaggattgatcccacctccaagtctccgggccaccttctcctgggaggacgaccatctctacccctag

SEQ ID NO: 125692 - DNA, 8574 bp, Homo sapiens
  Payload ID: 4635
  Gene Symbol: DIDO1
  Gene Name: death inducer-obliterator 1
  Uniprot ID: Q9BTC0
  ENST ID: ENST00000266070
  CDS Start-End: 357-7079
gtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccatggcagcctcaaagaaaacagcccctccaggctccgcggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcaacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtcttgagtcaccacgtccgaatataattcttgggttagtaatctgccaaaaaatcaaacgtcccgcaaacagtggagagttagacaagatggacgaaaagcggacccgacttcaaccggaagaagcggacgttccggcctatccaaaagtagccacagtcccgcagtcggaaaagaagccctccaagtatccactctgctctgcagacgcggctgtcagcaccacacctcctgggtcgccgccgcctccgccccctcttccagaaccaccggtgctaaaagtgctgtcatccctcaaacctgcagcccccagcccagccacagcagccacaacagcagcggcagcctccacggcagcttcctccaccgcttcgtctgcttccaaaacagcatcaccgctggagcacatcctgcagactctctttggaaagaagaaatcattcgacccgtccgccagagagcctcccgggtccaccgcaggtctcccccaggagcccaaaaccacagcagaggacggggtgccggcacctccgttgttagatccgatcgtccagcagttcggtcagttctcaaaagataaggctctagaggaagaggaggacgacaggccatacgaccctgaggaggagtacgacccggagagggccttcgacactcagcttgtggagcgagggcggcgccacgaggtggaaagggctcctgaagcagctgcagccgagcgggaagaggtggcctatgaccccgaggatgagaccatcttagaagaagcgaaagtgactgttgatgacctgcccaacaggatgtgtgccgacgtgagaaggaactccgtggagaggcctgccgagccggtggccggggctgcgacgccctccctggtggagcaacagaagatgctagaagagctgaacaaacagatcgaggagcagaagagacagctggaggagcaagaagaagctctcaggcagcagagggccgccgtcggggtctccatggcccacttctcggtgtcggacgccttgatgtctccaccaccaaagtcgtccttgcccaaggcagagctgttccagcaagagcagcagtctgcagacaagcccgcctcactgccccccgccagccaggcgtcaaaccacagggacccccggcaggcgaggcgcctggccactgagaccggtgagggggagggggagcctctctccaggctctcggcacgtggtgcccagggtgccctgcccgagagagatgcttccaggggtggcctcgtgggccaggcgcccatgccagtcccggaggaaaaagagccagcctcttccccctgggcttcgggcgaaaagcccccagcggggtccgagcaggacggctggaaggcagagcctggggagggcacccgccccgccacggttggagacagctcggccaggcctgcccggagggtgctgctgcccacaccgccttgcggcgccctgcagcccggcttcccgctgcagcacgacggtgagagggaccctttcacctgcccggggttcgcgtcgcaggacaaggctctcggctcagcccagtatgaggacccaagaaatcttcattctgctggaaggagcagcagccctgcaggtgaaacagagggggacagagagccacaggccagacccggcgagggcaccgccccgctccccccaccaggacagaaagtggggggctctcagcccccgtttcagggtcagcgggaacctggacctcatgctttggggatgtcagggcttcacggccccaatttcccgggaccaagggggccagcccctccgtttccagaagagaatatcgcttctaacgatgggccacgagggcctccgccagccagattcggagcccagaaggggcccatcccttccttattctcggggcaacatgggccacctccttatggggacagcagaggcccctcaccctcttaccttggtggaccacgaggagtggcaccatcccaatttgaagaacgcaaggatccccatggggagaagagggagttccaggacgccccgtataacgaggtgacgggcgcccccgcccagtttgaagggacagagcaagccccatttctgggaagcagaggcggcgcgcctttccagttcggaggccagagaaggccactgctgtctcagctgaaaggcccccgaggcggcccccctccctctcagtttggaggtcagagaggaccaccccctggtcatttcgtgggcccaagagggccccatcctagtcagtttgaaactgcccggggccctcatcccaaccagtttgaaggacccagaggccaagcgcctaactttatgccaggtcccaggggcattcagcctcagcagttcgaagaccagagggtccattcaccaccaagattcacaaaccaaagggcgcctgcacccctgcagtttggtggactacgggggtccgcacccttttctgaaaaaaatgagcagaccccttcgcgatttcacttccagggccaggccccgcaggtgatgaagccgggccccaggcccctgctggagcttcccagccaccccccgcagcaccggaaggaccgctgggaggaggccgggccgccctccgcgctctcctccagtgcgcccggacagggccccgaggccgacggacagtgggcatcggccgacttccgagaggggaaaggccacgaatacagaaaccagactttcgaagggaggcagagagagcggtttgacgtggggcccaaagagaagccgctggaggagcccgacgcccagggccgggcgtccgaggacaggaggagagagcgcgagcgcggccgaaactggagccgagagcgggactgggaccggccccgggagtgggaccgacaccgggacaaggactccagccgggactgggacagaaaccgggagaggagcgccaaccgcgaccgagagcgcgaggccgaccggggcaaggagtgggaccgcagccgggagcggagcaggaaccgagagcgcgagcgagaccggaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccataggttaaattacattaaagtaggtgtcacgttccaacatctagtacgatgagaaggttttgtttgtttaacatataaagcaaatttttctaatttaaatacacaaatgtaaaaatcaagtgtgtttctttagtttacttgatagagattcctgtacattgtattttatattgcggaggcttatatcactgtacatgagaacatggaacgacctaggttttgttactcgcagtagaataaacagctacaggaagtttc

SEQ ID NO: 125693 - DNA, 2707 bp, Homo sapiens
  Payload ID: 4635
  Gene Symbol: DIDO1
  Gene Name: death inducer-obliterator 1
  Uniprot ID: Q9BTC0
  ENST ID: ENST00000354665
  CDS Start-End: 238-1926
ggaaatggctgcgagaccctagaggcctgcggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcag

SEQ ID NO: 125694 - DNA, 2383 bp, Homo sapiens
  Payload ID: 4635
  Gene Symbol: DIDO1
  Gene Name: death inducer-obliterator 1
  Uniprot ID: Q9BTC0
  ENST ID: ENST00000370366
  CDS Start-End: 200-1834
gagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattca

SEQ ID NO: 125695 - DNA, 2704 bp, Homo sapiens
  Payload ID: 4635
  Gene Symbol: DIDO1
  Gene Name: death inducer-obliterator 1
  Uniprot ID: Q9BTC0
  ENST ID: ENST00000370368
  CDS Start-End: 233-1921
ggggaaatggctgcgagaccctagaggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtc

SEQ ID NO: 125696 - DNA, 2833 bp, Homo sapiens
  Payload ID: 4635
  Gene Symbol: DIDO1
  Gene Name: death inducer-obliterator 1
  Uniprot ID: Q9BTC0
  ENST ID: ENST00000370371
  CDS Start-End: 357-2045
gtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtctttaa

SEQ ID NO: 125697 - DNA, 7551 bp, Homo sapiens
  Payload ID: 4635
  Gene Symbol: DIDO1
  Gene Name: death inducer-obliterator 1
  Uniprot ID: Q9BTC0
  ENST ID: ENST00000395340
  CDS Start-End: 265-3834
ctcggtggccgtccgcccactccgcggcgttcggggaaatggctgcgagaccctagaggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccatggcagcctcaaagaaaacagcccctccaggctccgcggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcaacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtaagcgccggctttctgggtggaggtgaggcccacctgcacctgcacccctcctcccactgacatgccctgctgagtcctgaccagcccagggctctctgggagcaggagttaggagcacagacgcagcggttagcaataggattcatctttgagggcgtaggactgtggcacgagaagtacccctgattcacagcataaattgtcttaggagagttttttagagagggaaaaacccacagcctgcaaccagctcatcttggcctcaggtcagagaagactcagtgcccagaagcccaaggctcagccagaaagggaggtgacactcccagcggccctgctctttcctctagacagactcgggagccagcacacaccgggaagtggctccatcagggatcacttctctaacagggatggatttccaggagacttaacaataatgacatagaaaactatttctagaaataattattttaaaatctgcagctcaaattgtaataggttcattcatctttggcaagctattttgtgtttgcacgttccttggaaagtactgtatttaaacgattatttacaaatagcctaaaatacatctttgtcaagggttgagggtgattccaggggccacgtgctctgttagtgaccagctctttcatagccccttagaagaagctgatgtgacttcagttaggggttagtatctgatgcccaactgaagtgtctccgtggccatgcagtccccagaggattggtgttctctcaaagcgggtgtgtggatcacacagtgtcctctgaagtgcttcgtcataaaggcaggtgctgtctggaccctgtgcctcagtgccctctgtccctgtcaccaggcctcggcgggtgttcctgccatagctgtgcagggtgttcccacccacacccctcatgccgcaccctagctagctggggtcctgtaggggccactccacatcttgggcgggacttctgtcgccccaggcacagcccacgttcctactggagcccattcttcacagctggagtgggctcagcctatgcctgtgttgtggaattatatgtccataaagggattggttggtatcagtaatttcagggttaaatatttgctggcgtggtgcattaaattattttagtgccagataaatttttaaaagcaaagtgctttagtgtgtcccctcaaatcctacttgggataaagagatgccacctaatgggtggcagaaaggaccctggtagaggttcttggtgttgcttgtgaagagctctggccagctccacgtgaccagggagaggaaaagcccggccctcctggaggtgaagaccgagaagctggcctctccgcacctgtgaagacccactggtcagttgcaagtgcgacagtgtgtgcactcagtgcagacactgcagcacctcagcacctccctaccggggtggaaagagcactttttctttacagaaacatgattcttagatagcgagcctcccctttttaaaacaattgaggcgatatttcatcctttcttgagcttctctccctgctcatctccaaacttggagctgtcaggtgagcacggttgtagggtgttgagcgagccccggcgcatgccgggcaccgggttccccacactgggcagtgacggggcccagggaggccaccagaggagcggcgcctccattctccccacagcaagggctggctgtgcaggtgcagccccggggcagagggaaaggacaggtctcccagcacctcccggatggcaccgggacaaggagggctgggctggggtcactcaccttgtctgctgagtgcgatggcaccaaccacccacactgtcagctccgcgaccagctgggggaacgtcacactcgcccaccaaggcacttgctgaggccacgacgccgcctgacggggacacacaaaagccccagggactttgatccacgataaagagcagaggcgtctgggtaaagtaacacagggcaagggactttagaaaagtaacagctagtgaaacctttccatacacttcagaaatgttttaacttaagacttcagtataatgttaacttctcctgatgtccttgttgacatgaatgcgtgtgcgtgaaatctcacacacttccatggtcactaaacagccttcaccccgggccaggccatcgggtactcggcccgcttcacgtactgattacttgacttggcgttttctagatataaacatgtacatgtgtgtcctggctttgtggtgtaaatgtgtagtgcgtgtgcatgtgcgcgcgtgtgtgtgtgtaaggctaggtcctggcatgtttcccctgtctcagcggaccctgtcctcacggagatagcccagaagcccttggacagcacaggccacacctgagggtgctgatggtggtgactccacagagctgtggtcaggggtgagcgtgtgctgcgcagcttggagtcacgcccccagaagtgctgggtgagggtctgcaggacccagctccattccacagcctcagttctctgcggcacatgcagcacaggcctgaaggagacctggcgccccagccttgagctgcccgtctgcatcagggcactgatgtgggagcatcttcccctggggatgttaaggagaaggtcctgttgggggtagagattcacgcagaaaagagtgactgactcgtccatgtgcctcagtttataccacacaattgcaggtgtccatgcctcccacacatggggacctagtgggttttgacagcgtggtgtccagtcctagccccctcagtgcttgctgttcacacttaagcaagtgaaggcctgaaggtgcccagctgtgccctcaggggaaacttaagtcacccgccctgtcagcacttggcccttgtcgggcagtgagagtggagctgcccccgcagcaccctcaggagccatgcagttcacagcagtagctggatctccctgaggacatttgtccttgcatatcttaatgatttgtccacagaaacaccgggttgtcttcctctgcccctctgccccgcagtgggggcactctctgtaactcagcatcacggtggggggcagctgggaggcctggttccaggtgaccttctccacctagatgttcaccccactcagttccagctttaccaacagggccccccgcagggacttggggtcgcagagtcccggcctgtctcagggccttgttcatggaagggagatgagtcaggttgaaagctcatcgtgtagggttctgtgcagggcccttacaggactggaccgcagccaagatgcctgcctgttaaccatgcccagcccccgtcatttccgcgtgaagccgcaggcctcggagccttggtctgaaatgcctgtggagtaacctcggtccataaacatgggtgcacagtctgttctccccaagtacagggcaggaggaaacaccgccctctgtagctgctcgaatggaaagggctcttttctctgaggtctttatacattagaaagctcttctgggaagaatgtttgaatccatagtgtctttctgtattcacttttaattgctttctaaattagctgagaaattctgacttgaaatattgtcaggtaagcatttcttcagttttcatgtgtgtatgtaacagtagctttgcatggaaattgtaatcagagtcaaatacagtattgaatggaatgtactgccttctcctcctaaatcaataaacatctttcatggaaa

SEQ ID NO: 125698 - DNA, 8477 bp, Homo sapiens
  Payload ID: 4635
  Gene Symbol: DIDO1
  Gene Name: death inducer-obliterator 1
  Uniprot ID: Q9BTC0
  ENST ID: ENST00000395343
  CDS Start-End: 265-6987
ctcggtggccgtccgcccactccgcggcgttcggggaaatggctgcgagaccctagaggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatccacgaaggaagacaggaggtccgaggagaaagcggcagccatggcagcctcaaagaaaacagcccctccaggctccgcggtgggcaagcagcctgcacctagaaacctcgtgccaaagaagtcttcttttgctaatgtggcagcagccacaccagccattaaaaagccaccctcaggtttcaagggcaccatccccaagaggccatggctctccgctaccccatcgagtggtgcttcagctgccaggcaggccggaccggcacctgcagcggcaacggctgcctccaagaagttccctggctccgctgctttggtgggagccgtaaggaagccagtggtaccttctgttccaatggcctcgccagccccaggacgccttggggctatgagtgctgcaccatcgcagccaaattcacaaattcggcaaaatatcagacgctccttaaaagagattttgtggaaaagagtcaatgacagcgatgacttaatcatgacagaaaacgaagtaggaaaaattgccctccatattgagaaggagatgtttaacttgtttcaagttacagataatcgctacaagagtaaatatcgcagcatcatgttcaacctgaaggaccctaaaaatcagggactcttccatcgtgttctgcgtgaggaaatctctttggcgaaacttgtgagactgaagccagaagaacttgtatctaaagagctttccacgtggaaagagaggccagcgagatctgtgatggagtccagaactaaactgcacaatgaaagcaagaagacggcccccaggcaggaggccatccccgatctggaggactctccgccagtgtcggattcagaggaacagcaagagtcagcacgtgctgtccctgagaagagcacagcgccgcttctcgacgtcttcagcagcatgttgaaagacaccaccagtcagcaccgcgcacacctcttcgatctcaactgtaaaatttgcacaggccaggttccctccgcagaagatgagccagctccgaaaaaacaaaaattgtcagcttctgttaagaaagaagacttaaaatcaaagcatgacagctctgcacctgacccagctccggattcagctgatgaggtgatgccggaggctgtgcctgaagttgcctctgagccaggcctagaaagtgcttctcatccaaatgtggacagaacgtatttccctgggcctccaggagatggccatcccgagccctccccgctggaagacctgtccccctgcccagcctcctgtgggagcggggtggtcaccaccgtcacagtgtccggccgggaccccaggaccgctccaagcagttcatgcacagccgtggcctccgcagcatcccgcccagacagcacccacatggtggaagccagacaggatgtgccgaagcctgtcttgacttctgtgatggtgcccaagtccatactagctaagccatcctcatctcctgacccaagatacctgtcagttcctccgtcaccaaatatcagcacttcagaatcacgttcccctccagagggagacacgaccctctttttgtctcgactcagcaccatttggaaaggatttattaacatgcagagtgtggcaaaatttgtcactaaggcgtatcctgtctctgggtgttttgattacctcagtgaggatttgcctgacacaattcacattggtgggaggatcgcaccgaagacagtttgggattatgttggcaaactcaagtcttctgtgtctaaggagctctgtctgatccgcttccaccccgccacagaggaagaggaggtcgcctatatctctctctactcctatttcagcagccgtggccgctttggtgttgtagctaataacaacaggcacgtcaaggacctctacctgatcccgctgagcgcccaggaccctgttccatccaaactcttgccctttgagggaccaggtcttgagtcaccacgtccgaatataattcttgggttagtaatctgccaaaaaatcaaacgtcccgcaaacagtggagagttagacaagatggacgaaaagcggacccgacttcaaccggaagaagcggacgttccggcctatccaaaagtagccacagtcccgcagtcggaaaagaagccctccaagtatccactctgctctgcagacgcggctgtcagcaccacacctcctgggtcgccgccgcctccgccccctcttccagaaccaccggtgctaaaagtgctgtcatccctcaaacctgcagcccccagcccagccacagcagccacaacagcagcggcagcctccacggcagcttcctccaccgcttcgtctgcttccaaaacagcatcaccgctggagcacatcctgcagactctctttggaaagaagaaatcattcgacccgtccgccagagagcctcccgggtccaccgcaggtctcccccaggagcccaaaaccacagcagaggacggggtgccggcacctccgttgttagatccgatcgtccagcagttcggtcagttctcaaaagataaggctctagaggaagaggaggacgacaggccatacgaccctgaggaggagtacgacccggagagggccttcgacactcagcttgtggagcgagggcggcgccacgaggtggaaagggctcctgaagcagctgcagccgagcgggaagaggtggcctatgaccccgaggatgagaccatcttagaagaagcgaaagtgactgttgatgacctgcccaacaggatgtgtgccgacgtgagaaggaactccgtggagaggcctgccgagccggtggccggggctgcgacgccctccctggtggagcaacagaagatgctagaagagctgaacaaacagatcgaggagcagaagagacagctggaggagcaagaagaagctctcaggcagcagagggccgccgtcggggtctccatggcccacttctcggtgtcggacgccttgatgtctccaccaccaaagtcgtccttgcccaaggcagagctgttccagcaagagcagcagtctgcagacaagcccgcctcactgccccccgccagccaggcgtcaaaccacagggacccccggcaggcgaggcgcctggccactgagaccggtgagggggagggggagcctctctccaggctctcggcacgtggtgcccagggtgccctgcccgagagagatgcttccaggggtggcctcgtgggccaggcgcccatgccagtcccggaggaaaaagagccagcctcttccccctgggcttcgggcgaaaagcccccagcggggtccgagcaggacggctggaaggcagagcctggggagggcacccgccccgccacggttggagacagctcggccaggcctgcccggagggtgctgctgcccacaccgccttgcggcgccctgcagcccggcttcccgctgcagcacgacggtgagagggaccctttcacctgcccggggttcgcgtcgcaggacaaggctctcggctcagcccagtatgaggacccaagaaatcttcattctgctggaaggagcagcagccctgcaggtgaaacagagggggacagagagccacaggccagacccggcgagggcaccgccccgctccccccaccaggacagaaagtggggggctctcagcccccgtttcagggtcagcgggaacctggacctcatgctttggggatgtcagggcttcacggccccaatttcccgggaccaagggggccagcccctccgtttccagaagagaatatcgcttctaacgatgggccacgagggcctccgccagccagattcggagcccagaaggggcccatcccttccttattctcggggcaacatgggccacctccttatggggacagcagaggcccctcaccctcttaccttggtggaccacgaggagtggcaccatcccaatttgaagaacgcaaggatccccatggggagaagagggagttccaggacgccccgtataacgaggtgacgggcgcccccgcccagtttgaagggacagagcaagccccatttctgggaagcagaggcggcgcgcctttccagttcggaggccagagaaggccactgctgtctcagctgaaaggcccccgaggcggcccccctccctctcagtttggaggtcagagaggaccaccccctggtcatttcgtgggcccaagagggccccatcctagtcagtttgaaactgcccggggccctcatcccaaccagtttgaaggacccagaggccaagcgcctaactttatgccaggtcccaggggcattcagcctcagcagttcgaagaccagagggtccattcaccaccaagattcacaaaccaaagggcgcctgcacccctgcagtttggtggactacgggggtccgcacccttttctgaaaaaaatgagcagaccccttcgcgatttcacttccagggccaggccccgcaggtgatgaagccgggccccaggcccctgctggagcttcccagccaccccccgcagcaccggaaggaccgctgggaggaggccgggccgccctccgcgctctcctccagtgcgcccggacagggccccgaggccgacggacagtgggcatcggccgacttccgagaggggaaaggccacgaatacagaaaccagactttcgaagggaggcagagagagcggtttgacgtggggcccaaagagaagccgctggaggagcccgacgcccagggccgggcgtccgaggacaggaggagagagcgcgagcgcggccgaaactggagccgagagcgggactgggaccggccccgggagtgggaccgacaccgggacaaggactccagccgggactgggacagaaaccgggagaggagcgccaaccgcgaccgagagcgcgaggccgaccggggcaaggagtgggaccgcagccgggagcggagcaggaaccgagagcgcgagcgagaccggaggcgcgaccgggaccggtcccggagcagagagcgggaccgagacaaggccagggacagggagcggggccgcgaccgcaaggaccggagcaagagcaaagagagcgctcgggacccgaagcccgaggcctcgagggcctccgacgctggcaccgcctcgcaggcctagacgccccggccgggcagagaccctttttaaagccacgttcgtaagatgcgttgaacaaatagcttttgaaatagccacgatcttagattcaggatagaatattctggacttaaacattactgtaattttgtgtaaatggtttcttacaagatttcacatctttacaattctgatgcttttttaaaaaaactaaactttaatatttccatttaaaattaaaagaaatgggaaattgcctacggagcatattgcttttcagatcatagttatcttttccaataactttattgtaaattttaagggagtttcgttggaccctagagccataccttcactgacatctcatccgtttgtgtttccaaaagctgcttttacaggtcttagccgccgccccggaggccggtgtgggcgtgacctgcaggcgtccaccctgcggctacgggagaagtcttagtagcttgtatctggagtcttgagaaacacaaaccttacaaatgcatctttcttttgtcataaaattggaattacaattttcaactgggaaacagaaacacatttcttagcgtgctcagattttatatatcaccttatcaattttttccaaaacatgatttaaagcaacatctgtcctagtataattgttgcattttaaataacaatttattgaaaaatgttaagttttaccagcctaaaaaaagtaacaaaccaattaagtgtactttgggggcagggaggagtccttgatttgaataatcaggagttttgttggtccagtttcgccttctgagcagttcttctgtatcccgggaaaagtacgctcggccccaaactggtatttgtcagacgatacatgtaaaagtttgtccttgaacgtggaacaagacttgtgtaaagtctgagacgggaactagtgatcactagctcaagaactgcaaatgagacaggaagctgttcactgtgaaacagtctcttgcttgtcgtgtatttttcgagtacttctgaagtgtgaagtaaaaaaatctggctaatttatttgtacaaatacactttgataattttttatattttcataaacttttacagatgtaaaattaaagaacttcacttgttctttggagtctgttattccattgtacgtcactacagatttttcactttatagcacagattttttaagttaagaaaacattgagaatgtatcagtttgagatgtttggtgttgaaagccaagtgtccataggttaaattacattaaagtaggtgtcacgttccaacatctagtacgatgagaaggttttgtttgtttaacatataaagcaaatttttctaatttaaatacacaaatgtaaaaatcaagtgtgtttctttagtttacttgatagagattcctgtacattgtattttatattgcggaggcttatatcactgtacatgagaacatggaacgacctaggttttgttactcgcagtagaataaacagctacaggaa

SEQ ID NO: 125699 - DNA, 2339 bp, Homo sapiens
  Payload ID: 4636
  Gene Symbol: DAP
  Gene Name: death-associated protein
  Uniprot ID: P51397
  ENST ID: ENST00000230895
  CDS Start-End: 205-513
ggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgtcatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctcca

SEQ ID NO: 125700 - DNA, 1048 bp, Homo sapiens
  Payload ID: 4636
  Gene Symbol: DAP
  Gene Name: death-associated protein
  ENST ID: ENST00000432074
  CDS Start-End: 161-775
agtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgtcatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaa

SEQ ID NO: 125701 - DNA, 5743 bp, Homo sapiens
  Payload ID: 4637
  Gene Symbol: DAPK1
  Gene Name: death-associated protein kinase 1
  Uniprot ID: P53355
  ENST ID: ENST00000358077
  CDS Start-End: 184-4476
cttcagattgcaaaccttcttgccttcaagcctcggctccaacaccagtccggcagaggaacccagtctaatgaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgca

SEQ ID NO: 125702 - DNA, 5892 bp, Homo sapiens
  Payload ID: 4637
  Gene Symbol: DAPK1
  Gene Name: death-associated protein kinase 1
  Uniprot ID: P53355
  ENST ID: ENST00000408954
  CDS Start-End: 336-4628
ggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgtt

SEQ ID NO: 125703 - DNA, 5759 bp, Homo sapiens
  Payload ID: 4637
  Gene Symbol: DAPK1
  Gene Name: death-associated protein kinase 1
  Uniprot ID: P53355
  ENST ID: ENST00000472284
  CDS Start-End: 201-4493
agagcgcgccagcgagcccggagcgcggagctgggaggagcagcgagcgccgcgcagaacccgcagcgccggcctggcagggcagctcggaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgc

SEQ ID NO: 125704 - DNA, 4334 bp, Homo sapiens
  Payload ID: 4637
  Gene Symbol: DAPK1
  Gene Name: death-associated protein kinase 1
  ENST ID: ENST00000489291
  CDS Start-End: 73-639
caggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgg

SEQ ID NO: 125705 - DNA, 5899 bp, Homo sapiens
  Payload ID: 4637
  Gene Symbol: DAPK1
  Gene Name: death-associated protein kinase 1
  Uniprot ID: P53355
  ENST ID: ENST00000469640
  CDS Start-End: 536-4630
agagcgcgccagcgagcccggagcgcggagctgggaggagcagcgagcgccgcgcagaacccgcagcgccggcctggcagggcagctcggaggtgggtgggccgcgccgccagcccgcttgcagggtccccattggccgcctgccggccgccctccgcccaaaaggcggcaaggagccgagaggctgcttcggagtgtgaggaggacagccggaccgagccaacgccggggactttgttccctccgcggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatgccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatt

SEQ ID NO: 125706 - DNA, 4186 bp, Homo sapiens
  Payload ID: 4637
  Gene Symbol: DAPK1
  Gene Name: death-associated protein kinase 1
  Uniprot ID: P53355
  ENST ID: ENST00000491893
  CDS Start-End: 74-4168
gcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatgccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgg

SEQ ID NO: 125707 - DNA, 5772 bp, Homo sapiens
  Payload ID: 4637
  Gene Symbol: DAPK1
  Gene Name: death-associated protein kinase 1
  Uniprot ID: P53355
  ENST ID: ENST00000622514
  CDS Start-End: 211-4503
ggcgcgggggtgccaccgttgccgcaggctggagagagattgctcccagtgaggcgcgtaccgtctgggcgagggcttcattcttccgcggcgtccctggaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcatt

SEQ ID NO: 125708 - DNA, 2603 bp, Homo sapiens
  Payload ID: 4638
  Gene Symbol: DAPK2
  Gene Name: death-associated protein kinase 2
  Uniprot ID: Q9UIK4
  ENST ID: ENST00000261891
  CDS Start-End: 7-1119
gattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagcca

SEQ ID NO: 125709 - DNA, 1741 bp, Homo sapiens
  Payload ID: 4638
  Gene Symbol: DAPK2
  Gene Name: death-associated protein kinase 2
  Uniprot ID: Q9UIK4
  ENST ID: ENST00000457488
  CDS Start-End: 32-1144
gaccgcggcagctcagcctcccgccgattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctgaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctga

SEQ ID NO: 125710 - DNA, 724 bp, Homo sapiens
  Payload ID: 4638
  Gene Symbol: DAPK2
  Gene Name: death-associated protein kinase 2
  ENST ID: ENST00000559306
  CDS Start-End: 483-724
gaatccagctgctatgtcacgagaactcaagccaccctgtggagaattccacacggagtgcagctgaggcctcccaacaacaaccagcagcaatttgcaaaccatgtgtctcctacagctactggtgtgttttttgcatattggccttccaacatttcttgttgaattatttcaggctcaccttggtcataatgagtggatctggctttacccagggcttcagcctttagcatttcacatgaggaatatccactgagctgggggtcaagaggcctgacctttaatcttggctctgccccaggcaagtgtgaacttgggtaagaacactgaggccaggaaatgttgagtgacgtgtccatactcacatagcatggaagaatcagaggccatggggtcaggacctatgggcttaggatataccggaagaggcctgatttccagtcgagcatttgccaaaaatcagcagcgtgatttgggattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggt

SEQ ID NO: 125711 - DNA, 584 bp, Homo sapiens
  Payload ID: 4638
  Gene Symbol: DAPK2
  Gene Name: death-associated protein kinase 2
  ENST ID: ENST00000558064
  CDS Start-End: 1-147
atgaagaaggtgcacctgaggccggatgaggacctgacagagtttcactcttattgcttaggttggagtgcaatggcgcgatctcggctcaccgcaacctctgcctcctggcttcaagcgattctcctgcgtcagcctcctgagtagctgggattacagtcatgcgccaccacacccagctaattttgtatttttagtagagatggggtttctccatgttggtcaggctggtctcgaactcccgacttcaggtgatctgcccgcctcggcctcccaaaatgctgggattacaggcataagccaccatgccaggccaataatgacatattcttaaagcctggcatgtaagtgctcagtaagcgttagcaattgttgttgtttaaaaccttcctgtaggctggcagtagtggttcgtgcctatagtcccagcactttgggtggctgaggcgggaggttcatttaaggccaggagttaaagaccagcccaggcaacaacagtgagaccctgactctacaaaacaaaaacaaacaaacaaacaaaaaaattagccagatcatcatgacttggatgaaaagacattatg

SEQ ID NO: 125712 - DNA, 1473 bp, Homo sapiens
  Payload ID: 4638
  Gene Symbol: DAPK2
  Gene Name: death-associated protein kinase 2
  Uniprot ID: Q9UIK4
  ENST ID: ENST00000558069
  CDS Start-End: 7-1473
gattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgtcaaaaggagaaggcagagcccctgaacagcggaagacagagcccacccagctgaagaccaagcacctgagagagtacactctcaaatgccactcaagcatgcctcccaacaactcctatgtcaacttcgagcgttttgcctgtgtggtggaagacgtggctcgggtcgacctgggatgccgtgccctggtggaggcccacgataccatccaggacgatgtggaggccctggtctccatcttcaatgagaaggaagcttggtaccgagaggagaatgagagcgcccggcatgacctgtcccagctcaggtatgagttccgcaaggtggagtcattgaagaagctgctgcgagaagacatccaggccacgggatgtagcctcggaagcatggccaggaaactggaccatctgcaagcccagtttgagattctgaggcaggagctctccgcagacctgcagtggattcaggagctggtgggcagcttccagctggagagtgggagctctgagggcctgggctccacattctaccaggacaccagtgaatccctgtcagagctgctcagcagatcatgcactgaggaatttctggcaggctggaagctctaa

SEQ ID NO: 125713 - DNA, 566 bp, Homo sapiens
  Payload ID: 4638
  Gene Symbol: DAPK2
  Gene Name: death-associated protein kinase 2
  ENST ID: ENST00000561162
  CDS Start-End: 91-357
cccgccgcgcccgccgcgcccgccgcgcccgccgctcccgccgcgcctgccgcggccgcgaccgcggcagctcagcctcccgccgattgtatgttccaggcctcaatgaggagtccaaacatggagccattcaagcagcagaaggtggaggacttttatgacatcggagaggagctggggaggttcttggctggcattctgttgttccagactctccacctgctgctgactttgctgctgctccctgcgtgtttctcactcctgtcatgcccatctagttcccagcgcactgcccacctggctttgtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccaga

SEQ ID NO: 125714 - DNA, 4835 bp, Homo sapiens
  Payload ID: 4638
  Gene Symbol: DAPK2
  Gene Name: death-associated protein kinase 2
  ENST ID: ENST00000559007
  CDS Start-End: 7-282
gattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggagagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgccggtggacaaccagcaagccatggtgcgcagggagtctgtggtcaatctggagaacttcaggaagcagtatgtccgcaggcggtggaagctttccttcagcatcgtgtccctgtgcaaccacctcacccgctcgctgatgaagaaggtgcacctgaggccggatgaggacctggtgggtaaatgcatgccctcttcttgggcagaattctggggtagcctggagctcagggatgggtgagttccctttcccctcacaaggcaggtgggtgttcactgtttccagccagttctgctggcccagtcctcctcttccctgaaggctgaagtgtgatcttcagaggagtgtgttctggggacctctgggtggtgccgggaggggaccactgatgcagcagcatgaactcctggaggatctcccatcctttcctggtgggccttcagaggggccgctgctgccggctgaccacagacaacccaaaatgtatttctgataacccaaaagctgctttagaatgggagctttacattcttttttccatatttctatttctgctttgtttcagattaccatcatcataatatttagacaatatcttatatttgattactttattgccattttgtatacatttaaagggagtagcttataacagaatatactggtgaagagggtgccctctgcagtcagactaccaggattcaaatctgccacttaccgtgtgaccttgaggaaattacttaacctctctgtgctgatagttcatcatttgtaaaatagggttaataatagttcctaaagattaaataatgacatattcttcctcttcttcttcttctttttttttttttttttgtttgtttagacagagtttcactcttattgcttaggttggagtgcaatggcgcgatctcggctcaccgcaacctctgcctcctggcttcaagcgattctcctgcgtcagcctcctgagtagctgggattacagtcatgcgccaccacacccagctaattttgtatttttagtagagatggggtttctccatgttggtcaggctggtctcgaactcccgacttcaggtgatctgcccgcctcggcctcccaaaatgctgggattacaggcataagccaccatgccaggccaataatgacatattcttaaagcctggcatgtaagtgctcagtaagcgttagcaattgttgttgtttaaaaccttcctgtaggctggcagtagtggttcgtgcctatagtcccagcactttgggtggctgaggcgggaggttcatttaaggccaggagttaaagaccagcccaggcaacaacagtgagaccctgactctacaaaacaaaaacaaacaaacaaacaaaaaaattagccaggtatggtgacaggcacctatagtcctagctactcagggagctgaggtgggaggatcacttgagcccaggagttaaaggctgcagtgcagtggcaccatctcagctcgctgcaacctctgcctcccgggttcaagagattctcctgccttagcctcctgactagctgggattacaggcatgagccaccacgcccagccaaaaagaatgtcagtttctttccaaacttttgttcttgtacaaatattcttaaatagtactctttttactcaaatagcaagcaccatcagctcaaaggttcatcctagaagtggaaaaatgttgggtcccagatatctgttatgcagttttcccaaagggactttccttaaaaaaaaaaaaaaaaagagtaatgataggtccttttgtttaggaagcactggaattgaacattggacaacagatattttaggaatgaagtcactgtggattagtacttcttttaataattttataattacattagatcatcatgacttggatgaaaagacattatggcctcggggtggctgcctcagctctggtttgccatgtaggaactgacagacagtactttatactcatttcctgttttataaaaatggagctcagaagtcatttccctggaaacactggtcagcaaggcggctgaaggtgcagcccatcaaagaagaaggggcatgggatggtggctgtcaagcatggggagtaccttgtggctcacacccatcctccagtctctctaggctgagctcaggagacccagcagccacagaccacccagccaagtggccttgattatatggcagccacaaagggaactagatgtaattttctttattataatttggcctctcctgatgtctggtttcccttagatgccctgctgctttccttcctccaagcagttggtctggcctcgtttcagatccctcccatcccccagcccctggatggatcagcaggcttgctttcaccacccacctccctggcttgtagtcccgtggtccaggtgaatcaacccaggttgcccagcacagccccattcctggcgtctcatgatcctcctgccctggacctctttctcttttttttctccagaggaactgtgagagtgacactgaggaggacatcgccaggaggaaagccctccacccacggaggaggagcagcacctcctaactggcctgacctgcagtggccgccagggaggtctgggcccagcggggctcccttctgtgcagacttttggacccagctcagcaccagcacccgggcgtcctgagcactttgcaagagagatgggcccaaggaattcagaagagcttgcaggcaagccaggagaccctgggagctgtggctgtcttctgtggaggaggctccagcattcccaaagctcttaattctccataaaatgggctttcctctgtctgccatcctcagagtctggggtgggagtgtggacttaggaaaacaatataaaggacatcctcatcatcacggggtgaaggtcagactaaggcagccttcttcacaggctgagggggttcagaaccagcctggccaaaaattacaccagagagacagagtcctccccattgggaacagggtgattgaggaaagtgaaccttgggtgtgagggaccaatcctgtgacctcccagaaccatggaagccaggacgtcaggctgaccaacacctcagaccttctgaagcagcccattgctggcccgccatgttgtaattttgctcatttttattaaacttctggtttacctgatgcttggcttcttttagggctacccccatctcatttcctttagcccgtgtgcctgtaactctgagggggggcacccagtggggtgctgagtgggcagaatctcagaaggtcctcctgaaccgtccgcgcaggcctgcagtgggcctgcctcctccttgcttccctaacaggaaggtgtccagttcaagagaacccacccagagactgggagtggtggctcacgcctataatccctgcgctttggcagtccgaggcaggggaattgcttgaactcaggagttggagaccagcctgggcaacatggcaaaacgcagtctgtacaaaaaatacaaaaaattagccaggtgtaggggtaggcacctggcatcccagctactccaggggctgaggtgacagcattgcttaagcccagaaggtcgaggctgcagtgagctgagatcacgccactgcactccagtctgggtgacagagagagaccatatccaaaaaaaaaaaaagttgccagagacgagtatgcccatgctccctctacctcactgccaccactcctgctgttaggagctgagtgtgtctccctaaaatttctatgttgaagtcttaacccttggtaccacagaatatcactgtatttggagatggggtctttagaaaggcacttaaattaaaatgagctcactgatatgggccccgatgcaatataattggtgtccttataagaaggggaggttaggacacgcaggaaagaccacatgaaggcccaggagtgggagggggaatagccatcgacaaactaagggggcctcagaggaaaccaaccctgctgacacctcaatcttagactctggcctcaaaaattgtaagaaaataaacttctgtcttttaagcca

SEQ ID NO: 125715 - DNA, 8086 bp, Homo sapiens
  Payload ID: 4638
  Gene Symbol: DAPK2
  Gene Name: death-associated protein kinase 2
  Uniprot ID: Q9UIK4
  ENST ID: ENST00000612884
  CDS Start-End: 32-1498
gaccgcggcagctcagcctcccgccgattgtatgttccaggcctcaatgaggagtccaaacatggagccattcaagcagcagaaggtggaggacttttatgacatcggagaggagctggggagtggccagtttgccatcgtgaagaagtgccgggagaagagcacggggcttgagtatgcagccaagttcatcaagaagcggcagagccgggcgagccggcgcggtgtgagccgggaggagatcgagcgggaggtgagcatcctgcggcaggtgctgcaccacaatgtcatcacgctgcacgacgtctatgagaaccgcaccgacgtggtgctcatccttgagctagtgtctggaggagagctcttcgatttcctggcccagaaggagtcactgagtgaggaggaggccaccagcttcattaagcagatcctggatggggtgaactaccttcacacaaagaaaattgctcactttgatctcaagccagaaaacattatgttgttagacaagaatattcccattccacacatcaagctgattgactttggtctggctcacgaaatagaagatggagttgaatttaagaatatttttgggacgccggaatttgttgctccagaaattgtgaactacgagcccctgggtctggaggctgacatgtggagcataggcgtcatcacctacatcctcttaagtggagcatcccctttcctgggagacacgaagcaggaaacactggcaaatatcacagcagtgagttacgactttgatgaggaattcttcagccagacgagcgagctggccaaggactttattcggaagcttctggttaaagagacccggaaacggctcacaatccaagaggctctcagacacccctggatcacgtcaaaaggagaaggcagagcccctgaacagcggaagacagagcccacccagctgaagaccaagcacctgagagagtacactctcaaatgccactcaagcatgcctcccaacaactcctatgtcaacttcgagcgttttgcctgtgtggtggaagacgtggctcgggtcgacctgggatgccgtgccctggtggaggcccacgataccatccaggacgatgtggaggccctggtctccatcttcaatgagaaggaagcttggtaccgagaggagaatgagagcgcccggcatgacctgtcccagctcaggtatgagttccgcaaggtggagtcattgaagaagctgctgcgagaagacatccaggccacgggatgtagcctcggaagcatggccaggaaactggaccatctgcaagcccagtttgagattctgaggcaggagctctccgcagacctgcagtggattcaggagctggtgggcagcttccagctggagagtgggagctctgagggcctgggctccacattctaccaggacaccagtgaatccctgtcagagctgctcagcagatcatgcactgaggaatttctggcaggctggaagctctaatcgccagaatccagtcagtgatgcatcccaagaggtttgcagaagcatgttctcatccaccctgctgcggcctccagctagaattatcctgcaggggtgtgtgtctgtagtatagccttccagcccctccacagaatccagaattgctgaggtgccagttaattcttcattctgcacctcccctcaccaatctggttttctgggagggctctggcagggcagccaagctgttaaaacaattagagagtgagtacccctcagggtccccttctgcagagggaggatggctggccctggggaaatgcttgagaattgatttgtgatgaaggatttgttcatatctcactttctgcctacataccttatggactgtagatcttgggtaatatttgagttaattaggaataactaagtcagcatggtgctttcctgctacagaagcagggatttacaatgcatagagaaaataatattgcctttcgtttgcattgatttttcacttaccaagcactcatgtctgacaaatgacctcacttggtccttaaaagaactcagtgagataggaaggtgggtggcattattattattattatttacatgtaactgatgagaaaattgactcagagagggaaaatgatatagtcaatcagtacagatgaaacagaaacccaggatgcccatctctaagatgaggtatatgggagaaagtagtaaggctttgctgtaaatatctaccttaatattaaagtccaggtcccagaggtaaagtaagcaacttcatgtattctgccaggtgtaggtggaatgcatacacctgcagatgattgtcccaggagctctgtcccagaaggcaaagtcattgtccctacccatccctgtctctgtctgaagaccagcctgcaagcaggagagaaggaaggaaggagtcttcccattctccaccctttctcctcttctggctaacggccccaactctgtgtcgagaataaaggccagaaggtcctcaacaggaggttccttttcttatgtacctaggccattgggccttgaaggcctaagaagttccgtgagggtttttgaaaagggcaaacataaagatggggaagcgcaaggccacatggtcgtttcatgacccaaagctttgagcacccctccccaaggattataagatctcatctccctttctctgggggaggggacagtcaaccaactcatgtcaacagagcatggcatatgagcctagtgctgagctagaagcttgtgggtaggggcataacttgtatagttcaaagtgtcttcatggcctcacaaaacatccctatcttagaggcagactaaacgatattcccaatttagagctgaggaaacagggagaggatgggattttcccaaggtcacatcattatggcaaaagtagagaccttctaatgacaagtctgttgctctttctgcttcccctggctgcgccaggctccagaagtttactccctgcttgtgggggcagctcacacctggattcatccatccatttataaattatacttaggcaccaaccaacttccagatgcccggcttgactctggggatacaatgtttagtaaaaataggcctgattcctgtctcacggagtgctcagtccagcgaaggatttgaacattgaccaagaatcacagagagatagagctgcagcttgtgttcatgctgggagagaagcacatagcactgcaggggcctgccgtcagggtctgacagcatcgggggaagcgtcctgaagcagtgacactggaacggaggtcagctaagccaaccagggagagagaagtttcccaacagagccatcataccagagctctgtgatgagaggcggtgtggaaggttgagaatgtgaggactgaaagctggaggggagagaataggaatacagtgcggaaatgaccggagaacaagcaggagcagcagggctttggccatgtggaagagctctgcccttatcccgaaagtcatgagaagccagcgggttccaggtgctggggagggaatgccccgtgaacagctcagacaggaagtggtttaggacaagacaggaaagcttcatctcatgaaaccatttcttcagaatcctgtctccttttctatatgcatgaaggatcatttcaaatatcatatacaatatttgtaacagaaacttacttcatcagctatgagaaaccgtggtgataagatgcatcatcattttatggaccactaagaaaaaaggcccaagatggggcgtctaataggaaactctctctacccccaccacataaagctgtgatgccctcaatgagagggtaaatgagaaatagagccaccatgcagaaagggggagcaaggaaacccatgcatctcaaccttgacactaaatgggggtgaaaaatccttccctgagaacaggagtcccaagccggtggtactcatgcaggtttgctttctgaatttgcactatcagtgtgatccaaaagaacatcaagcagagagtgtaatgtccaacagtctgaggctgggtggccctggatggctggcaaaaacagtactatcctctcccggagcacctgccttctgtccgggccaacagtaagaatatgataccatcatctgggagatgcctcctgacttcagagatccaaaaatgtatatcttggaaccaatgaaagatggcaaaagctccatttcctacatcttaccccagagaattggttcaaatgacctgtctacagtctctccaaggtcttacctgccctgtcacgggaagttgtatacttgtttggtgctgagacactgcaaatattaaatgtccctttggccgtgttaacagaccttgaccttcacacagccaggtttctaaggagaggaagccactgatggggcaacacagggcaagctttttagtgaaggtcaaaatagaatgcaggcccagtgtggtggctcatgcctgtaatcccagcactttgggaggctgaggtgggtggatcacttgaggtcaggagtgtgagaccagcctggccaacatggagaaatcctgtctctactaaagatataaaaattagctgggcatggtggtgggtgcctgtagtcccagctactcaggacactcgggaggctgaggcaggagaatcgcttgaacctggaaggcggaggttgcagtgagccaagatcacgccattgcactccagcctgggtgacagagtgagactctgtctcaaaaaaataaaaaatagaatacagtaaaagagtaaaatgttggcaatgatttgaatggggaaaattgggaaaagggagggagaagtggttgttttagaatcatgatcagctatacacagtgctgagagtcacccatttagttggccgtgagctggactccgaactctaagtggttttccttatagcagtgacatcgtcctctctatgctcatgtccagtcactgtaactgtttctcacttagacgtgtcgtaaacagacctttttctgtacaaagagcttctaaagacaaatgaaagagagttgagaaatgcccccaagtcttttggggaaagcagaggagaccatgaccttcctctgtgtcctggccagctgaagtcccgtccttccatggcattggaacctgatgctgggggagcccgggggcctgtgggatgcagccacaggacctgcttatctctgctccccacacgccctcagctgactttttacaacagtgtggagggctaacaatggcgggaagggctgtgagaatggactgtttcgctggtgcctagaggaaggaaggcttgtgggtgctgctctgtgggcaggcccctctgccattgaggatttttaattcaccaaattgcaatttttttggtgggggagccgcacagagtctcactctgccgcccaggctggagtgcagtggcatgatctcggctcactccaacctctgcctcccaggttcaagcaattctcctgcctcagtctcctgagtagctgggactataggtgcgcagcaccatgcccggctaatttttgtatttttagtagagatgggggtttcaccacattggtcaggctggtctcgaactcctgacctcaggtgatccacccacctcggccttccaaagtgctggaattacaggcgtgagccactgcacccagcccagactgcaaataaaaggtcggcttctgtgctctgttcaaacaccatcctgggctgtttgggaggggaaagtgagtgtatgacatcgccctgaataacaattctcaaggaagctggcaagctggcccttggggaaggcagctgcctgtccctgctgtgaggcaggtgctcacagcctagcattgcctgactgtgtgtcagaaggtggggtgatggtttggtaatcgatgattctgcagctgtgggagcctggcagtgaagggatggagcagaggaataatggcagaaagagctggagtctcccccatgggccccctcccctcccttacaggtgatcatgaagatggtggcttcctacctcactccatcacgcagcacaggtggcccggcccttgctggaggtggctgtgtgcccagctgtcacccctactgtcaatcttctgtaaatgtctgtgggactggatgccttttttccttggtccgtgaaattcctgacccagcagtgggcatgttcacgttgcaaaagggtccagtcccgttgaacaaacactgattgtgctctggctcagggggaggtgacagacaaggacaagataacctcaaataaaagattcagtgtctggggcagatggggacccagccaactagattggaaaagctatggtgagtgataaaatagagcttcctcatctcctagaaatcaaaggagagaggaattctgattgagaaagggtaagagggttgcagagaagagaggccttcccagggacgccgtccccaccagtgaccgccctcctccactcccaagctgtgtcccttgaggaaggcatgagtaaaatctggaaggggggtggggctgagccaagattggggttaggaacttggaacagttgaatggagattaaagagagggagattacacagatttaaaagagtgttttaaactttttgttatggtcccctcagcaggaaaattgccaaaacttgcacagaagtataaggaatgggatagtggattccaggacctatgaccccgctccagcaggaatcaagtcatgcgggtcctctttcattcatctctcccattacttttcttctggggtattttaaagcaaatttcagacttatttaactcataagttctccagcataaatctctgctaaggattttcttcttctttttttctttttttttttttgagacagagtttcactctcgttgcccaggctggagtgcaatggcgcgatcttggctcactgcaacctccatcttccaggttcaagcaattctcctgcctcagcctcctgagtagctgagattacaggcacccaccaccacacccaactagtttttgtatttttagtagagatggggtttcatcatgttggccaggctagtcttgaactcctgacctcaggtgatctgcctgcctcggcctcccgaagtgctgagattacaggcatgagccaccgcacccagccaggactttctttttaatacaaccccatgccattatcacacttgacaaaatcagcaataattccttcatctcatctggattcccattccatcctcacatgtccccaccactcccaacagtgtcccattacagctggtttgttcaaatcaggatccaaacagtccacatgtggcatttggttgctacgtctctcaagtctcttgggttttataacagtacaaaaggaagaacctttgaagcttttcctggggacaaaaaattgctcagaaaactgatggtcccatagaagaataaaaaacagagcgtatccatgtcaagacctaactcagaaatgtgagaccaggccaagcaaggaaaggaatgtttctgcctccttccactggcttgttcactgtagggggcagccttcaggctcacagcctttctgcagctgtccctcccacttaggaggaggcagagcctcaagcctcccacaagccccatgtgctcctttcctgggaaaacaggtgggtgaaggcagcagagcccaggcttcagccatcaaaacatccagcgaaggggaggggtggaggggtgccacctataaaactccattgagggaagggcagcggggaggggtcctgggcaggagagaagtgggtgtgagagtgccctggctttcactggagtaaggggctggagagatggcacagatgggggttggaggtgcaatctgcttgcagttcctaaagaagacctagtatctagagaaaatcgttgtgtggggggtggagttgggggagtcgcctcttcagtaaagccaggattcctttttcatgccttagcagcggctgctgcttcctgcccctgcctgtggatgttggtactgacctggcacaccccactggactttttcaaaggcatttgcagctgcataaacaaaacttgactacccc

SEQ ID NO: 125716 - DNA, 2105 bp, Homo sapiens
  Payload ID: 4639
  Gene Symbol: DAPK3
  Gene Name: death-associated protein kinase 3
  Uniprot ID: O43293
  ENST ID: ENST00000301264
  CDS Start-End: 94-1458
gttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctccacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagat

SEQ ID NO: 125717 - DNA, 2257 bp, Homo sapiens
  Payload ID: 4639
  Gene Symbol: DAPK3
  Gene Name: death-associated protein kinase 3
  Uniprot ID: O43293
  ENST ID: ENST00000545797
  CDS Start-End: 245-1609
ggcggtggccagcgcggcggcgccggccgtattctccgggctgcggagggtaaagagcgggctcgggccgaggctggagggctgggtggggccagagcggcgcttcgggggcccgcggaggacgagggagggagagaatctgaggagctgggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctccacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagata

SEQ ID NO: 125718 - DNA, 626 bp, Homo sapiens
  Payload ID: 4639
  Gene Symbol: DAPK3
  Gene Name: death-associated protein kinase 3
  ENST ID: ENST00000593844
  CDS Start-End: 204-626
agagtggagaggtgggaggcttgtgtttgctggacaggtctgtccattaatctaggagaaaagggtggtgtctcagttcctcacttctgtctttccctgtcttctccagggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaag

SEQ ID NO: 125719 - DNA, 617 bp, Homo sapiens
  Payload ID: 4639
  Gene Symbol: DAPK3
  Gene Name: death-associated protein kinase 3
  ENST ID: ENST00000594894
  CDS Start-End: 1-278
tgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggtaagtggggaggtgggggagctccctgggcttcccgccttggccttctcgctggggtcccggggggccttcagcatttaaggcttgtggatgtgacaacccccagtggctggggagggtccccagaggagtgagcctgtgtggcgggggttgggtcctgggcgtgggatgtccagcacccgacagacctggtggcatccttggctggtgtgtgtccaacggggctgactcctggggccagggccgcagcgtttttctcgagagagcactctcggctttgcgtcgggctgggcagtctccgtcacgaggcgttgactctgctgccggatgagcccctgaacctcagttcacactggcaggtgggggctggcggggctgggtggcatcgcggggaccccgctcaggcttccctccttccta

SEQ ID NO: 125720 - DNA, 671 bp, Homo sapiens
  Payload ID: 4639
  Gene Symbol: DAPK3
  Gene Name: death-associated protein kinase 3
  ENST ID: ENST00000596311
  CDS Start-End: 197-671
acgtcggcgcaggcgcgtcgcggcggcaggggcgcggggcttctggaggcggcggcggtggccagcgcggcggcgccggccgtattctccgggctgcggaggggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagc

SEQ ID NO: 125721 - DNA, 599 bp, Homo sapiens
  Payload ID: 4639
  Gene Symbol: DAPK3
  Gene Name: death-associated protein kinase 3
  ENST ID: ENST00000601824
  CDS Start-End: 126-599
ggaagaggttaatcttgcgaggacagtggagggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaag

SEQ ID NO: 125722 - DNA, 2606 bp, Homo sapiens
  Payload ID: 4640
  Gene Symbol: DAXX
  Gene Name: death-domain associated protein
  Uniprot ID: Q9UER7
  ENST ID: ENST00000266000
  CDS Start-End: 199-2421
atatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgta

SEQ ID NO: 125723 - DNA, 2613 bp, Homo sapiens
  Payload ID: 4640
  Gene Symbol: DAXX
  Gene Name: death-domain associated protein
  Uniprot ID: Q9UER7
  ENST ID: ENST00000374542
  CDS Start-End: 206-2428
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgta

SEQ ID NO: 125724 - DNA, 2615 bp, Homo sapiens
  Payload ID: 4640
  Gene Symbol: DAXX
  Gene Name: death-domain associated protein
  Uniprot ID: Q9UER7
  ENST ID: ENST00000383062
  CDS Start-End: 206-2428
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaaagcttaagttttacacagaaacattaataaacaataaagttcttttcttactgta

SEQ ID NO: 125725 - DNA, 2614 bp, Homo sapiens
  Payload ID: 4640
  Gene Symbol: DAXX
  Gene Name: death-domain associated protein
  Uniprot ID: Q9UER7
  ENST ID: ENST00000383194
  CDS Start-End: 206-2428
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaagcttaagttttacacagaaacattaataaacaataaagttcttttcttactgta

SEQ ID NO: 125726 - DNA, 2608 bp, Homo sapiens
  Payload ID: 4640
  Gene Symbol: DAXX
  Gene Name: death-domain associated protein
  Uniprot ID: Q9UER7
  ENST ID: ENST00000399060
  CDS Start-End: 199-2421
atatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaaagcttaagttttacacagaaacattaataaacaataaagttcttttcttactgta

SEQ ID NO: 125727 - DNA, 2607 bp, Homo sapiens
  Payload ID: 4640
  Gene Symbol: DAXX
  Gene Name: death-domain associated protein
  Uniprot ID: Q9UER7
  ENST ID: ENST00000399344
  CDS Start-End: 199-2421
atatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaagcttaagttttacacagaaacattaataaacaataaagttcttttcttactgta

SEQ ID NO: 125728 - DNA, 371 bp, Homo sapiens
  Payload ID: 4640
  Gene Symbol: DAXX
  Gene Name: death-domain associated protein
  ENST ID: ENST00000421874
  CDS Start-End: 228-371
ttggggagagctgggcgctgagtctgaggggaatgctgtggtaccttcctgtccctgaaagggagtggagcggccgggggctgaactgggggagggggatttggcgggaagcgcatctagcggaccggccggacccacggttgggatctaagaggaatcgcgagagcgtagcgcgcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccaga

SEQ ID NO: 125729 - DNA, 371 bp, Homo sapiens
  Payload ID: 4640
  Gene Symbol: DAXX
  Gene Name: death-domain associated protein
  ENST ID: ENST00000446511
  CDS Start-End: 228-371
ttggggagagctgggcgctgagtctgaggggaaagctgtggtaccttcctgtccctgaaagggagtggagcggccgggggctgaactgggggagggggatttggcgggaagcgcatctagcggaccggccggacccacggttgggatctaagaggaatcgcgagagcgtagcgcgcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccaga

SEQ ID NO: 125730 - DNA, 2545 bp, Homo sapiens
  Payload ID: 4640
  Gene Symbol: DAXX
  Gene Name: death-domain associated protein
  Uniprot ID: Q9UER7
  ENST ID: ENST00000445009
  CDS Start-End: 139-2361
gcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaagcttaagttttacacagaaacattaataaacaataaagttcttttcttactgta

SEQ ID NO: 125731 - DNA, 2355 bp, Homo sapiens
  Payload ID: 4640
  Gene Symbol: DAXX
  Gene Name: death-domain associated protein
  Uniprot ID: Q9UER7
  ENST ID: ENST00000414083
  CDS Start-End: 174-2171
acgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgt

SEQ ID NO: 125732 - DNA, 751 bp, Homo sapiens
  Payload ID: 4640
  Gene Symbol: DAXX
  Gene Name: death-domain associated protein
  ENST ID: ENST00000419855
  CDS Start-End: 363-751
ggatgtgttcctggcatttgcccagggtccctcccctcccaggggtcccgtgcgacgtgccttggacaaggctttctttatcttcctggccctcttcctgacactgctgatgctggaggctgcttataagctgctgtggttactactatgggcaaagttaggggactggctcctggggacacctcagaaggaggaggagctggaattgtgaccacctttcctataaacatcttctttccccaccaaggagctcacctctggacccagccttgcctccacgagtccctccagcctccctaaacacaacgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagct

SEQ ID NO: 125733 - DNA, 702 bp, Homo sapiens
  Payload ID: 4640
  Gene Symbol: DAXX
  Gene Name: death-domain associated protein
  ENST ID: ENST00000440500
  CDS Start-End: 168-702
ggtgggagtgggaaggaaggcggagggaaccatgcgaggttctgagaattgcggcgagggtcgcctcgagagacggtttctgaggggctcattctgaggccccatccccttccagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctc

SEQ ID NO: 125734 - DNA, 2615 bp, Homo sapiens; identical to SEQ ID NO: 125724
  Payload ID: 4640
  Gene Symbol: DAXX
  Gene Name: death-domain associated protein
  Uniprot ID: Q9UER7
  ENST ID: ENST00000436311
  CDS Start-End: 206-2428

SEQ ID NO: 125735 - DNA, 2522 bp, Homo sapiens
  Payload ID: 4640
  Gene Symbol: DAXX
  Gene Name: death-domain associated protein
  Uniprot ID: Q9UER7
  ENST ID: ENST00000433482
  CDS Start-End: 116-2338
ggcggagggaaccatgcgaggttctgagaattgcggcgagggtcgcctcgagagacggtttctgaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaagcttaagttttacacagaaacattaataaacaataaagttcttttcttactgta

SEQ ID NO: 125736 - DNA, 702 bp, Homo sapiens; identical to SEQ ID NO: 125733
  Payload ID: 4640
  Gene Symbol: DAXX
  Gene Name: death-domain associated protein
  ENST ID: ENST00000446403
  CDS Start-End: 168-702

SEQ ID NO: 125737 - DNA, 371 bp, Homo sapiens; identical to SEQ ID NO: 125729
  Payload ID: 4640
  Gene Symbol: DAXX
  Gene Name: death-domain associated protein
  ENST ID: ENST00000451280
  CDS Start-End: 228-371

SEQ ID NO: 125738 - DNA, 371 bp, Homo sapiens; identical to SEQ ID NO: 125728
  Payload ID: 4640
  Gene Symbol: DAXX
  Gene Name: death-domain associated protein
  ENST ID: ENST00000419051
  CDS Start-End: 228-371

SEQ ID NO: 125739 - DNA, 702 bp, Homo sapiens; identical to SEQ ID NO: 125733
  Payload ID: 4640
  Gene Symbol: DAXX
  Gene Name: death-domain associated protein
  ENST ID: ENST00000428268
  CDS Start-End: 168-702

SEQ ID NO: 125740 - DNA, 751 bp, Homo sapiens; identical to SEQ ID NO: 125732
  Payload ID: 4640
  Gene Symbol: DAXX
  Gene Name: death-domain associated protein
  ENST ID: ENST00000453407
  CDS Start-End: 363-751

SEQ ID NO: 125741 - DNA, 751 bp, Homo sapiens; identical to SEQ ID NO: 125732
  Payload ID: 4640
  Gene Symbol: DAXX
  Gene Name: death-domain associated protein
  ENST ID: ENST00000414272
  CDS Start-End: 363-751

SEQ ID NO: 125742 - DNA, 2608 bp, Homo sapiens; identical to SEQ ID NO: 125726
  Payload ID: 4640
  Gene Symbol: DAXX
  Gene Name: death-domain associated protein
  Uniprot ID: Q9UER7
  ENST ID: ENST00000455860
  CDS Start-End: 199-2421

SEQ ID NO: 125743 - DNA, 371 bp, Homo sapiens; identical to SEQ ID NO: 125728
  Payload ID: 4640
  Gene Symbol: DAXX
  Gene Name: death-domain associated protein
  ENST ID: ENST00000457553
  CDS Start-End: 228-371

SEQ ID NO: 125744 - DNA, 751 bp, Homo sapiens; identical to SEQ ID NO: 125732
  Payload ID: 4640
  Gene Symbol: DAXX
  Gene Name: death-domain associated protein
  ENST ID: ENST00000438332
  CDS Start-End: 363-751

SEQ ID NO: 125745 - DNA, 702 bp, Homo sapiens; identical to SEQ ID NO: 125733
  Payload ID: 4640
  Gene Symbol: DAXX
  Gene Name: death-domain associated protein
  ENST ID: ENST00000454197
  CDS Start-End: 168-702

SEQ ID NO: 125746 - DNA, 751 bp, Homo sapiens; identical to SEQ ID NO: 125732
  Payload ID: 4640
  Gene Symbol: DAXX
  Gene Name: death-domain associated protein
  ENST ID: ENST00000453931
  CDS Start-End: 363-751

SEQ ID NO: 125747 - DNA, 702 bp, Homo sapiens; identical to SEQ ID NO: 125733
  Payload ID: 4640
  Gene Symbol: DAXX
  Gene Name: death-domain associated protein
  ENST ID: ENST00000429531
  CDS Start-End: 168-702

SEQ ID NO: 125748 - DNA, 2464 bp, Homo sapiens
  Payload ID: 4640
  Gene Symbol: DAXX
  Gene Name: death-domain associated protein
  Uniprot ID: Q9UER7
  ENST ID: ENST00000613912
  CDS Start-End: 208-2274
acgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaaagcttaagttttacacagaaacattaataaacaataaagttcttttcttactgt

SEQ ID NO: 125749 - DNA, 2463 bp, Homo sapiens
  Payload ID: 4640
  Gene Symbol: DAXX
  Gene Name: death-domain associated protein
  Uniprot ID: Q9UER7
  ENST ID: ENST00000619421
  CDS Start-End: 208-2274
acgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaagcttaagttttacacagaaacattaataaacaataaagttcttttcttactgt

SEQ ID NO: 125750 - DNA, 2357 bp, Homo sapiens
  Payload ID: 4640
  Gene Symbol: DAXX
  Gene Name: death-domain associated protein
  Uniprot ID: Q9UER7
  ENST ID: ENST00000612868
  CDS Start-End: 174-2171
acgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatacgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaaagcttaagttttacacagaaacattaataaacaataaagttcttttcttactgt

SEQ ID NO: 125751 - DNA, 2356 bp, Homo sapiens
  Payload ID: 4640
  Gene Symbol: DAXX
  Gene Name: death-domain associated protein
  Uniprot ID: Q9UER7
  ENST ID: ENST00000617660
  CDS Start-End: 174-2171
acgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaaagcttaagttttacacagaaacattaataaacaataaagttcttttcttactgt

SEQ ID NO: 125752 - DNA, 2462 bp, Homo sapiens
  Payload ID: 4640
  Gene Symbol: DAXX
  Gene Name: death-domain associated protein
  Uniprot ID: Q9UER7
  ENST ID: ENST00000620164
  CDS Start-End: 208-2274
acgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgt

SEQ ID NO: 125753 - DNA, 2357 bp, Homo sapiens; identical to SEQ ID NO: 125750
  Payload ID: 4640
  Gene Symbol: DAXX
  Gene Name: death-domain associated protein
  Uniprot ID: Q9UER7
  ENST ID: ENST00000612888
  CDS Start-End: 174-2171

SEQ ID NO: 125754 - DNA, 2464 bp, Homo sapiens; identical to SEQ ID NO: 125748
  Payload ID: 4640
  Gene Symbol: DAXX
  Gene Name: death-domain associated protein
  Uniprot ID: Q9UER7
  ENST ID: ENST00000616312
  CDS Start-End: 208-2274

SEQ ID NO: 125755 - DNA, 2459 bp, Homo sapiens
  Payload ID: 4640
  Gene Symbol: DAXX
  Gene Name: death-domain associated protein
  Uniprot ID: Q9UER7
  ENST ID: ENST00000622655
  CDS Start-End: 206-2272
gacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaagcttaagttttacacagaaacattaataaacaataaagttcttttcttactgt

SEQ ID NO: 125756 - DNA, 2666 bp, Homo sapiens
  Payload ID: 4641
  Gene Symbol: DBR1
  Gene Name: debranching RNA lariats 1
  Uniprot ID: Q9UK59
  ENST ID: ENST00000260803
  CDS Start-End: 155-1789
gatctggaaaccggaagtgaattattttgcaggagtctacacccaggcggtggctatacttattaaagttggcgggagctgagcgatcagtcggtcctgggctggctgtggtgtagggcgttgcaggcagcgctcacctcctcaggccggcagaatgcgggtggctgtggctggctgctgccacggcgagctggataagatctatgagacgctggcgctggcagagcggcgcggcccggggcctgtcgacctcttgctgtgctgcggcgacttccaggcggtgcgcaacgaggcggatctacgctgcatggccgtgccgcccaagtatcgtcacatgcaaaccttctacaggtattactctggagagaaaaaggctccagttctcacgctcttcattgggggaaaccatgaagcctcaaatcatttgcaagagttaccctatggtggctgggtggcaccaaacatttattatttaggtttggctggtgtggtaaaataccgaggtgtaaggatcggtggaatctctggtatctttaaatctcatgactatcgaaaaggtcattttgagtgccccccttataattcatctacaatcaggagtatatatcatgtgagaaatattgaagtctataaattaaaacagctgaagcagcctatagatatattcttgtctcatgattggccaagaagtatatatcattatggaaataagaagcaacttcttaagactaaatcttttttccgacaagaagtggaaaataacacattaggaagtccagctgcctcagagcttttagagcatctcaaacctacttattggttttctgcccaccttcatgtgaagtttgccgccttgatgcagcatcaggcaaaggataaaggacagacagccagagcaaccaaatttttagccttggacaaatgcttaccacatagagattttcttcagatattagagatagaacatgaccccagtgctcctgattacttggaatatgatattgaatggctcactattctcagggctacggatgatcttattaatgtgactgggcgcctgtggaatatgccagaaaataatggcctgcatgcaaggtgggattatagtgcaacagaagaaggtatgaaagaagtattggaaaaattgaatcatgatctcaaggttccatgtaactttagtgtaacagctgcttgttatgatcctagcaagccacagacacaaatgcagctgattcataggatcaatcctcagacaactgaattttgtgcccaacttggcatcatagacatcaatgttaggcttcagaagtccaaggaagaacatcatgtgtgtggtgaatatgaagaacaggatgatgtggagagtaatgactctggagaagaccagagtgaatataatacagacacatctgctctgtcttctattaatccagatgaaataatgttagatgaagaagaagatgaagatagtattgtaagtgcacatagtggcatgaatacaccatcggtagaaccttctgatcaagcttctgagttttctgcaagtttctctgatgtcaggatcttgccaggctctatgattgtatcttctgatgatacggtggattccacaattgatagagaggggaaacctggtgggactgtggagtcagggaatggagaggacttaaccaaggtgccattgaagaggctgagtgatgaacatgaacctgaacaaagaaagaaaattaagaggaggaatcaagccatttacgctgcagtggatgatgatgatgacgatgcagcttaagatgatttacttgttttgtttttgtgtttgttttgtttttttgagatggagtttcactcttgtcacctagactggagtgcaatggcgtgatctcggctcaccgcaacctccgcctcccaggttcaagcaattctcctgcctcagcctcccaagtaggtgggactacaggtgcccgccaccacacccggctaatttttgcatttttagtaatgacagggtttcaccgtgttggccaggctggtctccaactcctgacctcaggcgatccacctgtcttggccttctaaagtgctgggattacaggcgtgagccactgtgcctggccgacaatttacttgtcttagtattatatgtagatatgtgattttttgagactgtatttttagagctgaatttttgactaaagacttaactttataataatgaagatacattagagaattttagttagatattgactttatctttaggcttttgtatgtttcagatgcaaacatattaaagtttcatatatttacttgactgggtatctttttttttgaagacatacattattcacttccatttttacaataaacacttacttaacatctactctgtgccaagcactctgctataatatgggaccataaagatgagtaagacaaggatttttgcctccaaggacttgttatcactgtaaacattttgatgtatacaatatggctatattatattttgttttataaaatcaagtcattgtatatattatgatgtatgctttcttttcatttattataaatatttttcctgatcagcttttaatatctgtcaaataaaaattgaaattgaagatggtatataagatttcaggaaataaactactctgaatactaaa

SEQ ID NO: 125757 - DNA, 838 bp, Homo sapiens
  Payload ID: 4641
  Gene Symbol: DBR1
  Gene Name: debranching RNA lariats 1
  ENST ID: ENST00000477557
  CDS Start-End: 65-421
tcggtcctgggctggctgtggtgtagggcgttgcaggcagcgctcacctcctcaggccggcagaatgcgggtggctgtggctggctgctgccacggcgagctggataagatctatgagacgctggcgctggcagagcggcgcggcccggggcctgtcgacctcttgctgtgctgcggcgacttccaggcggtgcgcaacgaggcggatctacgctgcatggccgtgccgcccaagtatcgtcacatgcaaaccttctacaggtattactctggagagaaaaaggctccagttctcacgctcttcattgggggaaaccatgaagcctcaaatcatttgcaagagttaccctatggtggctgggtggcaccaaacatttattatttagctgaagcagcctatagatatattcttgtctcatgattggccaagaagtatatatcattatggaaataagaagcaacttcttaagactaaatcttttttccgacaagaagtggaaaataacacattaggaagtccagctgcctcagagcttttagagcatctcaaacctacttattggttttctgcccaccttcatgtgaagtttgccgccttgatgcagcatcaggcaaaggataaaggacagacagccagagcaaccaaatttttagccttggacaaatgcttaccacatagagattttcttcagatattagagatagaacatgaccccagtgctcctgattacttggaatatgatattgaatggctcactattctcagggctacggatgatcttattaatgtgactgggcgcctgtggaatatgccagaaaataatggcctgcatgcaag

SEQ ID NO: 125758 - DNA, 1479 bp, Homo sapiens
  Payload ID: 4642
  Gene Symbol: DCPS
  Gene Name: decapping enzyme, scavenger
  Uniprot ID: Q96C86
  ENST ID: ENST00000263579
  CDS Start-End: 330-1343
gggcgtcttcggctcccaccccggggcgtgggcctgggggtccctcttcactgcgcagccacctctagcccgccgctttcgggactctcagccttcttttcccttccctgagggccggccggcaccacaacggggccaaaggcagtaactcggttgaaaggcgcgccctgggacaggtcagcgggctccgccatgcgcggcacgcatcccgcaggagcgggtgccagagcagggtaggccgggagttagcagcccagccaggccgctggactcgggctaggggcggggccagcgcagggggcgcaggcgcacaccgcctccgcggcagcatggcggacgcagctcctcaactaggcaagaggaagcgcgaattggacgtggaggaggcccacgccgccagcacagaggaaaaggaggcaggagttggaaatggtacctgtgctcctgtccgcttaccgttctccggcttcagactgcagaaggtgctgagggagtctgcgcgggacaaaatcattttcctacacgggaaggtgaatgaggcctctggggatggggatggagaggatgccgttgtgatcctggagaagacgccatttcaggtggaacaggtggctcagctcctgacgggcagccctgagctccagttgcagttctccaatgatatctacagcacctatcacttgttccctccaagacaactgaatgatgtaaagacgaccgtggtttaccctgccacagagaaacacctgcagaagtacctgcgccaggacctccgcctgatccgagagacgggagatgactacaggaatattactttaccccacctggagtcccagagcctcagcatccagtgggtgtataacattctcgacaagaaggctgaagcggaccggattgttttcgagaacccagatccctctgatggttttgtcctcatccctgacctcaagtggaaccaacagcagctcgatgacttgtacttgatcgccatctgccatcgccggggcatcagatccctacgcgaccttactccggagcacttgccgctgctcaggaacatcctccaccaggggcaggaggccatcctgcagcgctaccggatgaagggagaccatctgcgagtatacctgcactacctgccctcctactaccacctgcatgtgcacttcaccgccctgggcttcgaggcccccggctcaggcgtggagcgggcccacctgctggctgaggtgatcgagaacttggagtgtgaccctaggcactaccagcagcgcacgctcaccttcgccctcagggctgacgaccccctgctcaagctcttgcaggaggctcagcaaagctgaattaactcaggcagaagagcacagatgtgtgggattgggggaggagtggggacaagattttttatctccaagtgaattttctaaaaatgtattttataccggcttattcctagtattgaataaactagcgggctca

SEQ ID NO: 125759 - DNA, 1628 bp, Homo sapiens
  Payload ID: 4643
  Gene Symbol: DXO
  Gene Name: decapping exoribonuclease
  Uniprot ID: O77932
  ENST ID: ENST00000337523
  CDS Start-End: 371-1561
gtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 125760 - DNA, 1667 bp, Homo sapiens
  Payload ID: 4643
  Gene Symbol: DXO
  Gene Name: decapping exoribonuclease
  Uniprot ID: O77932
  ENST ID: ENST00000375349
  CDS Start-End: 413-1603
gatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagagg

SEQ ID NO: 125761 - DNA, 1533 bp, Homo sapiens
  Payload ID: 4643
  Gene Symbol: DXO
  Gene Name: decapping exoribonuclease
  Uniprot ID: O77932
  ENST ID: ENST00000375356
  CDS Start-End: 310-1500
ggcgtgcctgccatgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcctaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgt

SEQ ID NO: 125762 - DNA, 1628 bp, Homo sapiens; identical to SEQ ID NO: 125759
  Payload ID: 4643
  Gene Symbol: DXO
  Gene Name: decapping exoribonuclease
  Uniprot ID: O77932
  ENST ID: ENST00000383330
  CDS Start-End: 371-1561

SEQ ID NO: 125763 - DNA, 1554 bp, Homo sapiens
  Payload ID: 4643
  Gene Symbol: DXO
  Gene Name: decapping exoribonuclease
  Uniprot ID: O77932
  ENST ID: ENST00000399936
  CDS Start-End: 297-1487
tgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcctaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 125764 - DNA, 1516 bp, Homo sapiens
  Payload ID: 4643
  Gene Symbol: DXO
  Gene Name: decapping exoribonuclease
  Uniprot ID: O77932
  ENST ID: ENST00000399937
  CDS Start-End: 259-1449
tggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 125765 - DNA, 1628 bp, Homo sapiens
  Payload ID: 4643
  Gene Symbol: DXO
  Gene Name: decapping exoribonuclease
  Uniprot ID: O77932
  ENST ID: ENST00000414092
  CDS Start-End: 371-1561
gtgatgacgaaaggagcgtcaacttgtcgtccctcaggcccgtcagtgctgggaggggcggtggcgacgcacataccagcatcacctccgccaggccgggccccacgccggccgcggattggctccctccaagggcacgcacgcccggggactcgttggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccgacctgctatgtggagctcaagacctccaaggagatgcaaagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 125766 - DNA, 1516 bp, Homo sapiens; identical to SEQ ID NO: 125764
  Payload ID: 4643
  Gene Symbol: DXO
  Gene Name: decapping exoribonuclease
  Uniprot ID: O77932
  ENST ID: ENST00000446967
  CDS Start-End: 259-1449

SEQ ID NO: 125767 - DNA, 1628 bp, Homo sapiens; identical to SEQ ID NO: 125759
  Payload ID: 4643
  Gene Symbol: DXO
  Gene Name: decapping exoribonuclease
  Uniprot ID: O77932
  ENST ID: ENST00000419797
  CDS Start-End: 371-1561

SEQ ID NO: 125768 - DNA, 1516 bp, Homo sapiens; identical to SEQ ID NO: 125764
  Payload ID: 4643
  Gene Symbol: DXO
  Gene Name: decapping exoribonuclease
  Uniprot ID: O77932
  ENST ID: ENST00000426498
  CDS Start-End: 259-1449

SEQ ID NO: 125769 - DNA, 1516 bp, Homo sapiens; identical to SEQ ID NO: 125764
  Payload ID: 4643
  Gene Symbol: DXO
  Gene Name: decapping exoribonuclease
  Uniprot ID: O77932
  ENST ID: ENST00000439989
  CDS Start-End: 259-1449

SEQ ID NO: 125770 - DNA, 1554 bp, Homo sapiens
  Payload ID: 4643
  Gene Symbol: DXO
  Gene Name: decapping exoribonuclease
  Uniprot ID: O77932
  ENST ID: ENST00000458308
  CDS Start-End: 297-1487
tgacgtcatagctctgcggaggtggaagttggggagctttgaggtaactggattcttgatctgagcgcagacgtccttcctaacctcactgcatttggaggacctggagggagggtgggtgaagggcaaggaaagaggcaggatgagagcttggccgcggtggcgtctgaggggcctgaatgtttcaaggccagagcctggcgatcaggtggctcgcttagtcctaaaccagtcatccttctccaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccgacctgctatgtggagctcaagacctccaaggagatgcaaagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 125771 - DNA, 1516 bp, Homo sapiens
  Payload ID: 4643
  Gene Symbol: DXO
  Gene Name: decapping exoribonuclease
  Uniprot ID: O77932
  ENST ID: ENST00000432110
  CDS Start-End: 259-1449
tggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccgacctgctatgtggagctcaagacctccaaggagatgcaaagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaagaggttc

SEQ ID NO: 125772 - DNA, 1554 bp, Homo sapiens; identical to SEQ ID NO: 125763
  Payload ID: 4643
  Gene Symbol: DXO
  Gene Name: decapping exoribonuclease
  Uniprot ID: O77932
  ENST ID: ENST00000427690
  CDS Start-End: 297-1487

SEQ ID NO: 125773 - DNA, 1628 bp, Homo sapiens; identical to SEQ ID NO: 125759
  Payload ID: 4643
  Gene Symbol: DXO
  Gene Name: decapping exoribonuclease
  Uniprot ID: O77932
  ENST ID: ENST00000453742
  CDS Start-End: 371-1561

SEQ ID NO: 125774 - DNA, 1628 bp, Homo sapiens; identical to SEQ ID NO: 125759
  Payload ID: 4643
  Gene Symbol: DXO
  Gene Name: decapping exoribonuclease
  Uniprot ID: O77932
  ENST ID: ENST00000454430
  CDS Start-End: 371-1561

SEQ ID NO: 125775 - DNA, 1554 bp, Homo sapiens; identical to SEQ ID NO: 125763
  Payload ID: 4643
  Gene Symbol: DXO
  Gene Name: decapping exoribonuclease
  Uniprot ID: O77932
  ENST ID: ENST00000427627
  CDS Start-End: 297-1487

SEQ ID NO: 125776 - DNA, 1554 bp, Homo sapiens; identical to SEQ ID NO: 125763
  Payload ID: 4643
  Gene Symbol: DXO
  Gene Name: decapping exoribonuclease
  Uniprot ID: O77932
  ENST ID: ENST00000443250
  CDS Start-End: 297-1487

SEQ ID NO: 125777 - DNA, 1346 bp, Homo sapiens
  Payload ID: 4643
  Gene Symbol: DXO
  Gene Name: decapping exoribonuclease
  ENST ID: ENST00000480240
  CDS Start-End: 259-891
tggcggcgtggaggggcgccggtggccacgttggtgtcaacctccttcgtgaagctcacacctcccccgccccgggaggggtttgcccgccactgtcgctgaatgattgcatcatcgaaagcagaaaaccacttttgcatccttcggcctctggcgtgcctgccatgacgtcatagctctgcggaggtggaagttggggagctttgaggcctcctctgtagaatggaaactctgtacccctgcttgtcttaggacctcatggatcccagggggaccaagagaggagctgagaagacagaggtagctgagcctcggaacaaactacctcgtccagcaccttctctgcccacagaccctgccctctactctgggccctttcctttctaccggcgcccttcggaactgggctgcttctccctggatgctcaacgccagtaccatggagatgcccgagccctgcgctactatagcccaccccccactaacggtccaggccccaactttgacctcagagacggatacccggatcgataccagccccgggacgaggaggtccaggaaaggctggaccacctgctgtgctggctcctggaacaccgaggccggttggaggggggtccaggctggctggcagaggccatagtgacgtggcgggggcacctgacaaaactgctgacgacaccgtatgagcggcaggagggctggcagctggcagcctcccggttccagggaacactatacctgagtgaagtggagacaccgaacgctcgggcccagaggcttgctcggccaccgctcctccgggagcttatgtacatgggatacaaatttgagcagtacatgtgtgcagccgcctgggaagccaccctctgctcttctcaggggaggtagactgcacagacccccaagccccatccacacagcccccaacctgctatgtggagctcaagacctccaaggagatgcacagccctggccaatggaggagtttctacagacacaagctcctgaaatggtgggctcagtcattcctcccaggggtcccgaatgttgttgctggcttccgtaacccagacggttttgtctcttccctcaagacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctccca

SEQ ID NO: 125778 - DNA, 586 bp, Homo sapiens
  Payload ID: 4643
  Gene Symbol: DXO
  Gene Name: decapping exoribonuclease
  ENST ID: ENST00000495340
  CDS Start-End: 1-524
acatgtgtgcagacaaacctggaagctccccagacccctctggggaggttaacaccaacgtggccttctgctctgtgctacgcagccgcctgggaagccaccctctgctcttctcaggggaggtagactgcacagacccccaagccccatccacacagcccccaacctgctatgtggagctcaagacctccaaggagatgcacagccctggccaatggaggagtttctacaggttcaggatcgggacctttcctaccatgaagatgtttgaatatgtcaggaatgaccgtgacggctggaatccctctgtgtgcatgaacttctgtgccgccttccttagctttgcccagagcacggttgtccaggatgaccccaggctcgttcatctcttctcttgggagcctggcggcccagtcaccgtgtctgtacaccaagatgcaccttacgccttcctgcccatatggtatgtggaagctatgactcaggacctcccatcaccccccaagactccctctcccaaatagtaatgctttagagggaggcagtcatatctctgtgtgcagataataaaagcatatttctaaga

SEQ ID NO: 125779 - DNA, 1853 bp, Homo sapiens
  Payload ID: 4644
  Gene Symbol: DCP1A
  Gene Name: decapping mRNA 1A
  Uniprot ID: Q9NPI6
  ENST ID: ENST00000294241
  CDS Start-End: 9-1643
gattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccatcccggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgac

SEQ ID NO: 125780 - DNA, 5994 bp, Homo sapiens
  Payload ID: 4644
  Gene Symbol: DCP1A
  Gene Name: decapping mRNA 1A
  Uniprot ID: Q9NPI6
  ENST ID: ENST00000610213
  CDS Start-End: 94-1842
ggggactgacgcagatgggggaattttgcctcgatggcactttcctgtccgcgactccgcccccaccagaggggctaggctctgggattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaaccctgggtgtcccttctgctgcccaccattcagtccagcctgaaatcaccaccccggtgctaatcactccagcctccatcacacagtccaatgaaaagcatgctccaacctacacaatcccgttgagccctgttctcagtcccactctgccagctgaagctcctactgcacaggttccccccagcttacctcgaaacagcaccatgatgcaggcagtgaagaccacgcctagacagaggtctccactcctgaaccagccagtccctgagctaagccatgccagtctgattgccaaccagagccccttcagggccccattgaacgtgacgaacacagctggcacatccctcccaagcgttgatcttctccagaaactcaggttgaccccacagcatgaccaaatacagacacaaccacttgggaaaggtgcaatggtagccagcttttctccggcagctggtcagctagccacacctgagagcttcatagagcctccctctaagacagcagcagcaagagtggcggcctcagcctccctgagcaacatggtgcttgctccccttcagtctatgcagcagaaccaggatcctgaagtatttgtgcagcctaaggtgttatccagtgccatcccggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaagaatgattccagcttcctcagtacacttcatgaagtctacttgcaggttctgaccaagaacaaagacaaccacaacctatgactggagcagaataagtctaaaggcagagccccagcctcagagacaaataggcttcatcatggaaacttctgagcagaacattgagtttgagaatcctgaaattgagcctatgagaaagagactcatttcttaagaatgttttccaagtgacattctcagtgataatggaggtttcactgtgaagcatcaccagcagatccttgttttgacaaaaaaaaaaaaaaaaaaaaaaaaaaagagagcgatcattgtgttaagttatgtgggtgttttcatcagctaggagcaaggctgtggaataaggagtcagattctcagcttgctttcactttcaaggacttacagaggagtagtcaccagcctcacagcagaagttcagcccggcccccaccgcttcccccagcctaccccatagaaacgggctttgggctgacaagtcaagttttgaacagagtagaaggcagctctgcaaagtagcttctagtttttaggaccagaatttaagccggcaaattaggaattatttcctcaagtgaagtatattttatatgaatgccccatttgggccttaaaagttgtgaaatttcttaatagcattttgtttttaagtgccccagtcctgccctgcagcaggcccccagtgcagcattaccatttgaatagggcactgtcaggctctggtggtgtggacacaggcatgtcatacctttgaaggaaaggctggggctgggaatgcccacatcctatcaaatcttcattttaggttaaactctccattggttctgaaaatgctaagtttgtgtgtgaagcacagccttattttccttttctgtcattgttgattgttttccttaacactttgacaaaaggaccagtggaccaatctgacaaagccattctggttcctttccttgagtgtactgagaatagttttaaagctatgcagaaaagggagctgttattcacactgcccttattttgttgtagaattatggagttaaaagaaaatgtgattccgaactctaccaatgtattcctaggctgtgagtactttcccggcccaaagtgtgaaaatatgtaaagaagctttgttatgctgctattgatctgccatgatttctatttattcttttatggcatgtaatggtgtttagtaatattttaatgtagattttgatttatttcagcaatagtaattttaagatattctttgaatgaaagtgtcttcgtttctatgatacaggtcattttgtagtatttaaccaattaagatgcactgcttacttttctgagcactatttaatgatggggtaaaaacccaattggctcaaccagctagcataaggattagctgtgaataatgctgacagatatgatggttccttaggaacaatcatttaagctttaatggtaactcaatcataagtccatagattatttttttctagctaaaattttagaaaattacttgtgaattacatacttgttttagtttggtcttagtttttagcataaagaatgattggcttttgttgatctaaacatgcttcctggacagggtttctgcttctcattttagtgtcttctattgctgtctacctaattatgtgtgaattgtgcagaattcagggaagcttataagttttcatgctcaattgtgaatagtttgttttcacagatagtatgtaaattaagcaaccaaaaatgaattccttatgcatcatctgggaacgagaaagctatagtgggatacagagtgttgctgacaccgggagatggtgtccagggagccacgtgacttccataaagtggacgcaccagtaggtgtgattgcacctcaagtgtagtctcagtgggcttcggtgaacagacgaatcaagggattcttgaatcgaaattatgcttttgagtatgtaatattatgagagagttaagagagaatatcctaaagagagtctgtgatcatactaattttcacctttaatgctaggaatggatatgatagacagtaaagagcatctatgataaggcttccttagtgtgaaagtaaacttaagtgcccaagtcatggagacttgaaaagggtaaacctgtttcacctcccaaatttatatattcaaagtatttacttaaaattcagaagccagaagttcatgtcatgattaccaggaagttcaggccagaatgaatccctagagaagccaggccaagcctggataattgcagctggatgaccctggcccgaaagtcacagttcagttgccttattcctagttcaggcttactatctagaacctcatgctagcttaggttgcatgtttacattgctgcagtgtctttactggaagcttagttggatcgaaatggacaccgagatggagatgcttctggctagatttcgcagaaccccaggagacctgcatttagaccactctgtccatttgtgtgcccacccccacccccagggtctaagtgtagactccaagaggagcagcccagagcttggaggagaggtgtgtctggggcaccactggtgggtggtgctgctcttctttttgttgtagttaatgcggtgtcttttaatggactctcaggcctcccagacagccttgttcctttaaggcagaagctcttcttcattgtgtacctcctgggattcatgaggtgtgagatttggcctgcttgactttgaattcaagtttttcaagtgactctcagtgtcagaagaagcatttcatgctgtccacatgtggtatgtccacagctcaccttcaaaggcttagatgtagccatcacagagagtggtattttattaagaacccaagtcccagcctgaccaacatggtgaaaccccatctctactaaaaatacaaaaattagccgggcgtggtggcacgcgcctatactcccagctacttaggaggctgaggcaggagaatcacttgaacccgggaggcagaggttgcagtgagccaagatcacaccactgcactctagcctgggcgacagtgagactccacctcaaaaaaaaaaaaaaaaaaaaaaaaaaaaaagtcacgctgggcccctctctacagggggacacacaggcttagtttagtatatgtctaaccagattttgcatgtcaagcatttgtccttttcctggcttatgttttcttgtagaaattatataaaccctatcaaatccactactaggtaaatttttaaaccatgcagctttattactctcctcccccaaagaatgtagtttgaaattttctcatttccatagtagaggccctaactgccattgtattactaataatgcaacatgaaattgaaggtgcctaactgctcaaaaaacaaaatcagccatcatactgtaactctgagaggaatgagaggtggcacaggcacgagtgggctcagcccgtgtgagtgaggagaactgaggaatcctagggtgcgcatcctgcatcctggctgcacgtttgctgcagagtatgtttttctttcttgcctcccttcagttttcttcagttgcgttcagtgtatcttctggaaccaatagtgccctgtgttctcaagtctctaaaatgctaagatctgagcaaagtcaagcagcttacactaggcttttttacagctgtgcttgagaacatttccgagtggaccagggccttgaggagcctgtttttcagcaaattcaacagatgtgtgcagtgattccctccgttttgtatttgacaccttcatttaaaatgctaagatgcaatatcattcacttcaaagtggggaaaatgcagaattgtgtttcctttttatctgtgtgattccttaagaaacatgtttttaaaatatgtgttctaaatggttttttattctgtattactgctttggccatgtggctctcatgactttcattgtaccagattctcagctccctgaaacatggggacgagaagctctggaattacagcaagatttttgttccatgagcgcaatactgtatcattaacatttttaatggtatggattttatagcatctgtgtatgtttgcaaatattaagttattacatgttttaaaatgagcgtttttcatcttaaattttatatgtttgcaaatatatttttttaataaaatttcaaaaccaagttttagcacctac

SEQ ID NO: 125781 - DNA, 849 bp, Homo sapiens
  Payload ID: 4644
  Gene Symbol: DCP1A
  Gene Name: decapping mRNA 1A
  ENST ID: ENST00000560624
  CDS Start-End: 70-849
tttgcctcgatggcactttcctgtccgcgactccgcccccaccagaggggctaggctctgggattcaagatggaggcgctgagtcgagctgggcaggagatgagcctagcggccctgaagcaacacgacccctatatcaccagcatcgcagacctcacgggccaggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaagcaccgagactctagaagaaatgccctccgggtcacaggataagtctgctccatctggacacaagcatctgacggtagaagagttatttggaacctctttgccaaaggaacaaccagcagttgtgggtctggattcagaagaaatggagaggttgccaggagatgcctcccagaaagagcccaattcattcctaccatttccctttgagcagttaggaggagcccctcaatcagaaacc

SEQ ID NO: 125782 - DNA, 581 bp, Homo sapiens
  Payload ID: 4644
  Gene Symbol: DCP1A
  Gene Name: decapping mRNA 1A
  ENST ID: ENST00000559748
  CDS Start-End: 8-581
attcaagatggaggcgctgagtcgagctgggcaggagatgagcctagcggccctgaagcaacacgacccctatatcaccagcatcgcagacctcacgggccaggtcgctctgtacaccttctgccccaaggccaaccagtggactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagcttgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctgggttacagccaagcactcagctctccaatctgggaa

SEQ ID NO: 125783 - DNA, 625 bp, Homo sapiens
  Payload ID: 4644
  Gene Symbol: DCP1A
  Gene Name: decapping mRNA 1A
  ENST ID: ENST00000560076
  CDS Start-End: 27-335
agaggggctaggctctgggattcaagatggaggcgctgagtcgagctgggcaggagatgagcctagcggccctgaagcaacacgacccctatatcaccagcatcgcagacctcacgggccaggtcgctctgtacaccttctgccccaaggccaaccagtgggagaagactgatatagaagggaccttattcgtatatcgaaggtcagcttccccttaccatggttttaccattgtgaatcgactaaatatgcacaatctagttgaaccagtgaataaagatttggaatttcagctccatgaaccatttcttctgtatagaaatgcaagctgttgagaaaacaagaggctcagagctgtttaggaatctgctcgagattcgcaaagtgtcgatatatagtatctggttttatgacaagaatgactgtcaccgcatagcaaaactcatggctgatgtggtagaagaggagacacggcgatcccagcaagctgctcgggacaaacagagtcccagccaggccaatggctgcagcgaccacaggcccatcgacatcctggagatgctgagcagagccaaggatgagtatgagaggaatcagatgggtgactcaaatatctccagccctg

SEQ ID NO: 125784 - DNA, 2086 bp, Homo sapiens
  Payload ID: 4645
  Gene Symbol: DCP1B
  Gene Name: decapping mRNA 1B
  Uniprot ID: Q8IZD4
  ENST ID: ENST00000280665
  CDS Start-End: 81-1934
tgcgaggcagctcgctcgttctgcgatctattgagagtggcttccaagagccccgtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagattgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtcatctcacctcagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaaggttctttcatgttgagtgttgtttccttcaatgtttctgccttttttaaaaaaaaagtatgtgtaatatgaagtaaaatgtttcagacttttttttat

SEQ ID NO: 125785 - DNA, 1547 bp, Homo sapiens
  Payload ID: 4645
  Gene Symbol: DCP1B
  Gene Name: decapping mRNA 1B
  ENST ID: ENST00000540622
  CDS Start-End: 60-1232
tgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccagtactcacaaatatcaagagccgagtgagaaaggcaagcatttcagcagcccacgctgtgctcagaatgcttgactccacctccgggagcatcactgctcagcaccgctcctcgaaatgtcatgtagggacaagttaaaagaaacagcctgccttcctctaggccaacttttgctcaaagagacgctaagggattgattataaaattacagcaacttctagcttgctggcctccttgcctccctcttaggagttctttcggggagttcggaggctgataaataacattctttttcttccctgagttagaagcaaatgatagctgtaggagtcagtcagataag

SEQ ID NO: 125786 - DNA, 2073 bp, Homo sapiens
  Payload ID: 4645
  Gene Symbol: DCP1B
  Gene Name: decapping mRNA 1B
  ENST ID: ENST00000543381
  CDS Start-End: 40-399
ttccaagagccccgtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagatatgaggaaactgagactccagtgaggaggcagactgtgtaaaaacccacagattctgatttcacttccgttgctttttccacaccacctgtactgctctactattaaacatggatgcaaattaaagtgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtcatctcacctcagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaag

SEQ ID NO: 125787 - DNA, 2231 bp, Homo sapiens
  Payload ID: 4645
  Gene Symbol: DCP1B
  Gene Name: decapping mRNA 1B
  ENST ID: ENST00000535873
  CDS Start-End: 105-566
gtgtggtcgccgtgggttctcggttgcgaggcagctcgctcgttctgcgatctattgagagtggcttccaagagccccgtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagatgtgagtctttcttactacagtgggttgttttacttctgaagtttggccaagtgtttaaaattgtacagtgtttgccattgtgtttgcatttggtatcagtggctatggggggtgtcagcattttaacaaatgttaatgtttaggaaatgcatgccctaatgatggaatagattcttccttggaagagtttaagtgaatataaatatgatgatataaacctaaaccctgtcttttgaagctttatggatttgtagtgtgaacccattgctgatcttaagcctgagcagggctgggtgaggcaagttcttagtgaggagactgcagagacacacacataggtggctccctgaacgaagaattaacgagtctgctatggcactttttctttatgtatcacttttggccgagtgagctgacaaagtgtttgagggcctgtattgtaggagtgccatcttctgaatacaagtaaataaaaaatcaaagtccaaaaagtttctttcagtcattaagaatttaataaccctttgtaatgtggaagtcgtagtaggtaactaaatagtccttgtcagatttgaaatgaagtagccatcgcctttctcatactacattttactctcgtatcgtttctgaccacttgtgttgcactgctggtcagcccagaggaagattgctgaaaatatgccagttgcagggacatctctacacacagaaaacaagaacataatactcaatatataaatacatatgtgtgcacacacatgcaccttatgctttgtggacagctttcataaagaccttgcagtgaagaaatgttttctgtatatttttcatcctactctttgaactcaagatacatgaatttgcctaccatatactattcagtgtaattttaatgagtataatgtaaataatatttgacattttaaccccaatgcatcattaagatgcattaaaatgatgctgtatataattgtcataataggtggttatcctattatttagagaataaatttttatgagagaaaaaaataaagctattgaaactataatatgacttactaatggcaggtcctgtgaaatgaaaagttttgcaatatagaaaaatattgtgttttctcctcatgtttctttgccgaaaggtacactttatcaattgtagtttattactaaagacttggaattccaactccaggaccctttccttctctacagaaatgccagtttgaattgtttatagtttgaattgttttgtgtgcttatagttatgtcagggttttttttgagattattagattttatgtcaaattaatatataatttaagtcctaataaaataactacaaagttacctgtaatcatcacttttggttgcttttattttggataaatacatggtctgatcagttataggtaatattttattttaaattcttattatagatcacatattaactactataccaaaaatataaaaacacaaactctctttaatgcatcaatttaaaaaataaccttcttaagtcccacagggtttatctgatagaaaatactatttagatctaataaacatacaccttggttctaagcgtgtgctgtccactatgatagtcactaactactgtggccgtttagtacctgaagtgtggctagtctaaacggagctgcactgtgagtgtccaacaggcaccaactgtcagacagtgcaaaaaaaaaaggaaaaaacctcaattattaattattttatattaacatgttgaaatgacaatattttggataaattgggcaaaataaaatatattattaatttca

SEQ ID NO: 125788 - DNA, 8947 bp, Homo sapiens
  Payload ID: 4646
  Gene Symbol: DCP2
  Gene Name: decapping mRNA 2
  Uniprot ID: Q8IU60
  ENST ID: ENST00000389063
  CDS Start-End: 199-1461
agtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcagccgatttattttgcatattcccagcgaggaaagagacaatgcaatccgagtgtgttttcagattgaacttgcccattggttttacttggatttctacatgcagaacacaccaggattacctcagtgtgggataagagactttgctaaagctgtcttcagtcattgtccgtttttgctgcctcaaggtgaagatgtggaaaaagttttggatgaatggaaggaatataaaatgggagtaccaacatatggtgcaattattcttgatgagacacttgaaaatgtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaatcaaagtatgaggggaaatggcagaaaacagtatcaagattcacctaatcaaaagaaaagaacaaatgggcttcagccagcaaagcagcagaattctttgatgaagtgtgaaaagaaacttcatccacggaaacttcaggataattttgaaacagatgctgtatatgacttgcctagctccagtgaagaccagttgctagaacatgctgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctgagatgtcacattcgtcagcattacaggtgatctattttggtggcattttgtacttctctctgcttctaaccactgaggctctctaatcttcctctggagttttagtgaaaggatttattgagcagcttctggaatataatgtgcatgtccaaaatgaactcagcgcttcaaaaggacaaagtctgtagcctggaggggcttgagtggatgggagctgatgctgtgattttgagctgtggttacatgcagtcagtaaacctgtgagactgctggaggaaatgtagcagacagcatggaggctgggacccagcagctactttgggtcatgtctttactgtcctgcctccaaccctttagtctcgtagacttttgttcttgtggaaatttcttctgtattccagttgtgtaaatatgtatggaaaactgatattactaggttttacgttgcatctccagtattgatctttggaaactgatgttacattaggttccaattcgcaatagtagcagagactgacatgcttttattgacctgctaagcccctggatgatggagcgagaagggaaggggtatgcagtttacccaagtccaaataaagcatttcactaggttacacgttatgtatatgtgttacataacagtaacatacataactcactcctaggaatgtattttgcttcaggatttttaaattcaaataaggatggcagtgcccattttaaggaggatttcagctataactgaggacaatcaccagggcgttaagggggctttagtgttttggctgcatctgacctcattgaaggaatttcttgggagtcgggggtgtttgagtatatgtgtgtgtgtgtaactatcatgtgggttttaaaaatccttttttacagtggtatccacaaaatacttctctgcttataaatgttattgtagaaatctttattctgtgtaggtagcctatttaattgggttccactgaacctcatgggacttttaaaagaagggctatttaaggaattcacttggtagtactttgctttagcttttaaatggcttgattttaaaggagaaattctatttattaatgaaagtgtcacccttttggtgctaagcaggagaattcacaattaaagcagtgtgtatagaattatgatattcagaatcctgcatcttttaatgtgacaaatttttgaatcctgtgacttttgctttttaatgcattatatgattgtgtttggaagcttttactgttcttttcagaaatacggctgctttgcttgggtctcttcgagccatatttatagttggtcccagcattccagacttctggtaaattgttaaaggagtgaaaatgtagtttgcctggcagatgaataattttcactcatttattgtcttctggaaaccatttaacttttactgttttttatttttttggtatgtgtttttttttttctttttaagtgcatactttggccagtcttcctggtgcctgtagagttggatttttcagctctcaatactgaagcaaaagagattatagttaccagaagtatggcctctaatggtgttgagccttttcaagaaccaacaaattatctttgtgattacagtagtttaactatggttaaatgttactgctgttgcgctgctttatttaatgcactgtggaacaaaatataagggtactgttggggtgtgattatgataacttcaggcttttagctctcctcaaagtttgaggttaaaaaaatgttaaaagatgtgagttaaagtttatgtgtgtgatgtgacttaactatgcagaaaatatttaagttggatgtacttgttttaggtacatctactatacttattctctcaaacctgggtaatagtttctcagtgttcaggttaccttgagaaaggccatgcttagcgaactggatttctcctttgagaaattttagtatggtttgaggaaatcaagtgataaaggagtatgctgaatatgcaatcatttacttctactgagtgctgcattttaagatgctagatgagaagagtagttggttttgcttcattatgttttatgtctttgagagagatacaggtcttggaattcactttttaaatgttacgttccaaccttatatgttccaaggtgcagtgcactgtgaatcttttatttttaaaaaaatttgtaggtgcttttatgtataactttaatgatttataagatgctaaatgaattgtttttgtacctaaccattgtaatccaaaagataagggtgtggtttacatgcttttcaaaaatttttgttaagaagtagcaaatgaatggtttaggatttcaaatagtgataccctcctgagacatgagcatttggagaggcctgagaacctaatagaactcatatagtgtgagtgaaatttgattaaagatgttggaaaatgaagttggatttttgtattcatgtataaaggaaagtctcccagtgctgtcaaaggaattgtggttactacttgctgttctgagctttgaatatcgttatttttctattaaatatcaattagtaagtatagctaatgaagacatataatgaaagtaattttatgctgtaagattgaattggtacttttccttattaaggctttagtaatttgtatgtaatgtcaaataaaaggaattcaaatctgagtaaataacagcctcctactataggaattagattcttctataaaagtcaccatattgtatcctatagaaaagttaaggtctgagtgcatgtgtgcattaaaaacatttcactacctattctctcatggacttctcatcctttcttttttcatctccaacagttaaatggtaaggagagcaaagttaattataaaaattagacattttgccaagttagttttcttaccacaataccctcttggcttttttttttttttttttgagatggagtttcactcctgttgcccaggctggagtgcaatggtgcaatttcggctcaccgcaacctacgcctcccgggttcaagtgattctcctgcctcagcctcccaagtagctgggattacaggcatgcgccaccacgccctgctaattctgtctttttagtagagacggggtttctccatgttggtcagggtggtctctcttggctttttatctttatttttgtaccagtggaccttcctgctccctgagactgttttgattgacatcttttgtgtttctatattttccgaggcagtattttctttgtatgttaatcatagttatagtaaagtcagactcattaacttttcttcctagtaattttgacttggattattttctagcctgggggatggggttcatatgtgttgttgtaactttagattactaaacaaaacaaactgtttttttgtttgaaggtatcctttacatacctgtctgtaggtaagcaagtgttagtaaaaacaattttgtcaaacagtactcctgacagcttggtaaagtctaggtagagtttctgattttgtattatgtcctaagacttgaaagtgcatttgtctagttgccaaaagttctaaaaatgagatggtgggctttctcagcatctttttgcttcctagaattgagttgctcttgaagtctgtactcctgtgtcagaaagatggcagactgcaaatgggcagtacaggctttgccccatgctttcaaagtaggattctggattgcagtttcaaaaaaatatgatagattattgttatagaatcaaagtgtcctgaagggagaagaatagctatagttgctgggcaaagagtgtaagaaagaaactttagagcatttatcaatacttgagtgctttattatgttccaggctagaaatgtgatcattgcatggcctaagtgtagtcattcatatatatatgaatatctatatctatatctatacatatatatgtatcgccattatcgagtgttttctagccctggataaagttaatttttttgaagtttgattgccaagcaatccagtgaatctaaagtaatttttctcactttaaagaccagtgatgaggagtctggtccttcctgtactgatactgtagaactccagtcaaacttcagtgcactgctttcttacaggaagacaactcagaacacacagccataatctgctttggtgtcagtcacatcacagtggttatacatttgtcctgaatggtgattcattcctttccatctaacttccttgtgacaaatagcatttactattgaaatagtcttaaaatagggaaaagagtgaaagttactcttatgcatgggagtgggcttaaagggttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgactttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttatgttaagcaaattattttgagaccttttgctggtagacaaaaactgaggaaatgtttcactaaatatattatggtcaatgaaaaaaccagactttagagtaaatgtgataaccaagtagatttgtgaactttatttctttagtaattatttttatcttatgtgaaatgattcaacctttaatttttgcctagattatagcaatgttttgttttaccttatagggcattttaatgcttggagaaagactataagtgaatctacttcaagggattctgttcatggtggtatacagttcttggtgctcttttggaaattgtcaaacatttactgatagcagaaaaggaaccccaaaacacctgtagtgttcaccttgttataagaacagaaacatttggaacaggtttcattctgtttctagatttatgttgttgtagttgaacagcaactgtttttttccctcagtgttaacgaaaggataaagactacctgtattgttgggtatgactatcaaaggatttccggtgattcatgtttgtgaattggagtttaaatgtttgcaggattactgtacttccaaagacccactagaatgtcagctgtactctgtactctccactgagaaaatgaacaaaatcctatgtcttaacagttatgctctaactttttgaaagctttttgatgtaaataataggttagaaactaaaagccttttaatcttacaaaatacaatttgaacgatggaaggttgttcagatactggctttctgtaaaaacatcattgtgttagattgtttgtaatgtactatcaataaaattggctgcttgggcggttttagttaccacctta

SEQ ID NO: 125789 - DNA, 1572 bp, Homo sapiens
  Payload ID: 4646
  Gene Symbol: DCP2
  Gene Name: decapping mRNA 2
  ENST ID: ENST00000513585
  CDS Start-End: 1-1207
gggggctccgccccgagccttggcccagtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcaggtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaatcaaagtatgaggggaaatggcagaaaacagtatcaagattcacctaatcaaaagaaaagaacaaatgggcttcagccagcaaagcagcagaattctttgatgaagtgtgaaaagaaacttcatccacggaaacttcaggataattttgaaacagatgctgtatatgacttgcctagctccagtgaagaccagttgctagaacatgctgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgca

SEQ ID NO: 125790 - DNA, 8029 bp, Homo sapiens
  Payload ID: 4646
  Gene Symbol: DCP2
  Gene Name: decapping mRNA 2
  Uniprot ID: Q8IU60
  ENST ID: ENST00000515408
  CDS Start-End: 233-1390
gtgactccgggggctccgccccgagccttggcccagtcttggggtccaaggctgagggagcgggacggaagtgagcgggtcccgccccttccccttctcgtctccgttggagtcgtctctgccgcggcttcctcggctgccagctctccggcgagccggagtcctagtgccgtaccgtcagtccccggccgcgcggagccgggatgcactgttcctgctgtgggtcctcatcatggagaccaaacgggtggagattcccggcagcgtcctggacgatctctgcagccgatttattttgcatattcccagcgaggaaagagacaatgcaatccgagtgtgttttcagattgaacttgcccattggttttacttggatttctacatgcagaacacaccaggattacctcagtgtgggataagagactttgctaaagctgtcttcagtcattgtccgtttttgctgcctcaaggtgaagatgtggaaaaagttttggatgaatggaaggaatataaaatgggagtaccaacatatggtgcaattattcttgatgagacacttgaaaatgtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagtcgaaccaaattccgccacagtcagcagttatttcctgacggttctcctggtgaccagtgggtaaagcacaggcaaccactgcagcaaaagccatataataatcattctgaaatgtctgaccttttaaaaggaaagaagtgtgaaaagaaacttcatccacggaaacttcaggataattttgaaacagatgctgtatatgacttgcctagctccagtgaagaccagttgctagaacatgctgagggacagcccgtggcatgtaatggacattgcaagttccccttttcatccagagcctttttgagtttcaagtttgaccataatgctataatgaaaatcttggacctttgatagcagcacatgtattgtaaatgtcccaggatcagagacctgttgaatttgagtgggtgtctcctcaagccttacctttctcaggtgttttaaagaaatgcagggaggcaatgtttctgaagacattttctgtttataagagagtagaaagaaacacgagtttgcactgtaaatgcagttataaccttttatacagatttaccttttcagtgttcagtacaagtttaagttgctttctttgagggcatttattctgtgtgactgtgggttttattttgtattctggttaagaaaataatgtattgagttactgtcaagtagccaagttaatgggaatgctccatctacctgttacagtgattgcaataatagtatattggagtttttcaaagaaacttaaagtaatgcccaattattaaatgaacacaagagctgagatgtcacattcgtcagcattacaggtgatctattttggtggcattttgtacttctctctgcttctaaccactgaggctctctaatcttcctctggagttttagtgaaaggatttattgagcagcttctggaatataatgtgcatgtccaaaatgaactcagcgcttcaaaaggacaaagtctgtagcctggaggggcttgagtggatgggagctgatgctgtgattttgagctgtggttacatgcagtcagtaaacctgtgagactgctggaggaaatgtagcagacagcatggaggctgggacccagcagctactttgggtcatgtctttactgtcctgcctccaaccctttagtctcgtagacttttgttcttgtggaaatttcttctgtattccagttgtgtaaatatgtatggaaaactgatattactaggttttacgttgcatctccagtattgatctttggaaactgatgttacattaggttccaattcgcaatagtagcagagactgacatgcttttattgacctgctaagcccctggatgatggagcgagaagggaaggggtatgcagtttacccaagtccaaataaagcatttcactaggttacacgttatgtatatgtgttacataacagtaacatacataactcactcctaggaatgtattttgcttcaggatttttaaattcaaataaggatggcagtgcccattttaaggaggatttcagctataactgaggacaatcaccagggcgttaagggggctttagtgttttggctgcatctgacctcattgaaggaatttcttgggagtcgggggtgtttgagtatatgtgtgtgtgtgtaactatcatgtgggttttaaaaatccttttttacagtggtatccacaaaatacttctctgcttataaatgttattgtagaaatctttattctgtgtaggtagcctatttaattgggttccactgaacctcatgggacttttaaaagaagggctatttaaggaattcacttggtagtactttgctttagcttttaaatggcttgattttaaaggagaaattctatttattaatgaaagtgtcacccttttggtgctaagcaggagaattcacaattaaagcagtgtgtatagaattatgatattcagaatcctgcatcttttaatgtgacaaatttttgaatcctgtgacttttgctttttaatgcattatatgattgtgtttggaagcttttactgttcttttcagaaatacggctgctttgcttgggtctcttcgagccatatttatagttggtcccagcattccagacttctggtaaattgttaaaggagtgaaaatgtagtttgcctggcagatgaataattttcactcatttattgtcttctggaaaccatttaacttttactgttttttatttttttggtatgtgtttttttttttctttttaagtgcatactttggccagtcttcctggtgcctgtagagttggatttttcagctctcaatactgaagcaaaagagattatagttaccagaagtatggcctctaatggtgttgagccttttcaagaaccaacaaattatctttgtgattacagtagtttaactatggttaaatgttactgctgttgcgctgctttatttaatgcactgtggaacaaaatataagggtactgttggggtgtgattatgataacttcaggcttttagctctcctcaaagtttgaggttaaaaaaatgttaaaagatgtgagttaaagtttatgtgtgtgatgtgacttaactatgcagaaaatatttaagttggatgtacttgttttaggtacatctactatacttattctctcaaacctgggtaatagtttctcagtgttcaggttaccttgagaaaggccatgcttagcgaactggatttctcctttgagaaattttagtatggtttgaggaaatcaagtgataaaggagtatgctgaatatgcaatcatttacttctactgagtgctgcattttaagatgctagatgagaagagtagttggttttgcttcattatgttttatgtctttgagagagatacaggtcttggaattcactttttaaatgttacgttccaaccttatatgttccaaggtgcagtgcactgtgaatcttttatttttaaaaaaatttgtaggtgcttttatgtataactttaatgatttataagatgctaaatgaattgtttttgtacctaaccattgtaatccaaaagataagggtgtggtttacatgcttttcaaaaatttttgttaagaagtagcaaatgaatggtttaggatttcaaatagtgataccctcctgagacatgagcatttggagaggcctgagaacctaatagaactcatatagtgtgagtgaaatttgattaaagatgttggaaaatgaagttggatttttgtattcatgtataaaggaaagtctcccagtgctgtcaaaggaattgtggttactacttgctgttctgagctttgaatatcgttatttttctattaaatatcaattagtaagtatagctaatgaagacatataatgaaagtaattttatgctgtaagattgaattggtacttttccttattaaggctttagtaatttgtatgtaatgtcaaataaaaggaattcaaatctgagtaaataacagcctcctactataggaattagattcttctataaaagtcaccatattgtatcctatagaaaagttaaggtctgagtgcatgtgtgcattaaaaacatttcactacctattctctcatggacttctcatcctttcttttttcatctccaacagttaaatggtaaggagagcaaagttaattataaaaattagacattttgccaagttagttttcttaccacaataccctcttggcttttttttttttttttttgagatggagtttcactcctgttgcccaggctggagtgcaatggtgcaatttcggctcaccgcaacctacgcctcccgggttcaagtgattctcctgcctcagcctcccaagtagctgggattacaggcatgcgccaccacgccctgctaattctgtctttttagtagagacggggtttctccatgttggtcagggtggtctctcttggctttttatctttatttttgtaccagtggaccttcctgctccctgagactgttttgattgacatcttttgtgtttctatattttccgaggcagtattttctttgtatgttaatcatagttatagtaaagtcagactcattaacttttcttcctagtaattttgacttggattattttctagcctgggggatggggttcatatgtgttgttgtaactttagattactaaacaaaacaaactgtttttttgtttgaaggtatcctttacatacctgtctgtaggtaagcaagtgttagtaaaaacaattttgtcaaacagtactcctgacagcttggtaaagtctaggtagagtttctgattttgtattatgtcctaagacttgaaagtgcatttgtctagttgccaaaagttctaaaaatgagatggtgggctttctcagcatctttttgcttcctagaattgagttgctcttgaagtctgtactcctgtgtcagaaagatggcagactgcaaatgggcagtacaggctttgccccatgctttcaaagtaggattctggattgcagtttcaaaaaaatatgatagattattgttatagaatcaaagtgtcctgaagggagaagaatagctatagttgctgggcaaagagtgtaagaaagaaactttagagcatttatcaatacttgagtgctttattatgttccaggctagaaatgtgatcattgcatggcctaagtgtagtcattcatatatatatgaatatctatatctatatctatacatatatatgtatcgccattatcgagtgttttctagccctggataaagttaatttttttgaagtttgattgccaagcaatccagtgaatctaaagtaatttttctcactttaaagaccagtgatgaggagtctggtccttcctgtactgatactgtagaactccagtcaaacttcagtgcactgctttcttacaggaagacaactcagaacacacagccataatctgctttggtgtcagtcacatcacagtggttatacatttgtcctgaatggtgattcattcctttccatctaacttccttgtgacaaatagcatttactattgaaatagtcttaaaatagggaaaagagtgaaagttactcttatgcatgggagtgggcttaaagggttgacttccaccagctgagtacaaacaagtgtaaagaaaaactatgataaagtatggaggtcttgagaattgttcataatgaaatctttaatctgggttatcagagtaatgaaatcaccaataaaaacattccatttatcttggatcttctgtggttagcagaggagtatggtctagctatgttagcagcttgaaggcacaacgtaaaaggaatgagctttcacaaggtgcttacgttagctgggtagtattggtcaaaggtactctgaagagtgaatgcagaaatcagttggctgtgtttgtaatcttgtcccacatggaccctaacctttagtagacttcagtcttttagtccagtagaagacaatggccctgaatatgtgttttctgctttttggtggaaggtttcctgcaggtggttgggtggtttttgggttattggctactgttcgttcagtgccatttgaagacctgttgtttcttaatcctttttcttggtgtgactggccaggaaaaagtccattgagtcctttttttctccctggtgtcttaccccttctgtagaataatccatattttaaaatttgtttcacatctttatagcaaacctgccacagacttgcaagcagtgattttatctttccttcctgagaaggtgatctcacttttgatgtttgggtcacctgtggacacctgtgctcttttgagtctcaaggcttatagctttcacattggcttgggaacaacagacttgtgtgtggttctagagtgaaatgggcagtgttctgctggtcctcagtctttgagaggtcttaggcaacatccttagtatagtggaatttctgaggtcaaatttaacatttaatatattctccttttagttcattgaatctgaggttctaaatctgtagcttcattttgagcacaagtctgcattgtcattttttaagagattggcaggcatatccttttgtgatacttaggaaaagactatggatggcagcaaatgaaagtaaaggttctcaactgtgaatgaaatttagaaagataattcttcagcagttggttgattagatgggttagtgcttttggaatatataacagtagacttgtattctttatgcactatacatatgatacgcactgacagaaaagcacagaagacatactgctaagagtttctttgtgcatttcactactgttctaggggactgctgtctctttggttccttttaggtttgtgttaggatgttgcacaagtaatcatttaatgttaaatgcaagtgtccaaagaaatgagtcttaaagttctttggtcatatttcactttagagttaggacaggagacagctaacctgacttccattttacaaatattagaaactttttcttcagtaacaaaaacagggaaggacaataaaaccatgaactattttgctttatgtctgtttttaaaaaataattgttttgaagtttgcttattagcttaataccttatagtacttttaaaaaatcatccttggtaattattgacttatcctagatccatgtacaattcagacttttatctgttagctttaataaaaatttaaaaccatctcatttcagaataaaataaacggaattacagttcatgcattagcatttttaagtgaagttctcttaataagattgccttttgtctaaccgaaatagggcatacagattagtttggatgggaaagtggtaagacttgactttttaatactgtgcctatttccaaaagaagacttgatgtggctttttacattatgctttaaagatgttaatggaggatacatagtcttaaaacaatttgtttgggagtaagttttagtcggaaaaaggtgaagatatttatgctgagttat

SEQ ID NO: 125791 - DNA, 570 bp, Homo sapiens
  Payload ID: 4646
  Gene Symbol: DCP2
  Gene Name: decapping mRNA 2
  ENST ID: ENST00000512751
  CDS Start-End: 125-349
caaacgggtggagattcccggcagcgtcctggacgatctctgcaggtactactagttcaggggtacctagcaaaatcaggctggggatttccaaaaggaaaagtaaataaagaagaagctcctcatgattgtgctgctagagaggtctttgaagaaactggttttgatatcaaagactatatttgtaaggatgattacattgaacttcgaatcaatgaccagcttgctcgtttgtacatcattccaggaattccaaaagacacaaaatttaacccaaaaactagaagagaaattcggaacattgagtggttctctattgagaaattgccttgtcatagaaatgatatgacccccaaatccaaacttggtttggcacctaacaaattttttatggccattccctttatcagaccattaagggactggctttctcgaagatttggcgattcctcagacagtgacaatggattttcctcaactggtagcacgccggctaaacccactgtggaaaaattgagaatcaaagtatgaggggaaatggcagaaaacagtatcaagattcacctaatc

SEQ ID NO: 125792 - DNA, 7156 bp, Homo sapiens
  Payload ID: 4647
  Gene Symbol: DCN
  Gene Name: decorin
  Uniprot ID: P07585
  ENST ID: ENST00000052754
  CDS Start-End: 503-1582
aatgctacttgtaaacaaggctagaaagggtggagaatgaaatgagatggggggtggggaaacaaaccctttagttacaatatcttagggaaatgaatctacaataagacaaatttcaaatcaagttgctccactatactgcataagcagtttagaatcttaagcagatgcaaaaagaataaagcaaatgggaggaaaaaaaaggccgataaagtttctggctacaatacaagagacatatcattaccatatgatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtgacttcatgtaatcaggctgaacatttctacaattactagatgtattagacgtaagtattttctttagttaaaccacccatgttagaaatgttttctgtagaatttataaacaactatcaatgcagacaatttaataagcctggggatgatttacttacagtaaacatttatcaaattgtacatttgtgctatcaacaattaataagcaaatatgtgaaaatagtttctgtcttctatgaagttagatatttgatggttaaaacccctataaatcatagtttcatatgggaaaaaataattgaaatacagtgtaaatttaaataatttattaagtatagcaaataattgaaatatggtggactaaattttgtcatagaaatatgtgcaagttatagtagtggctcacatgagaggtaatcaattctgctaatagtagcagaatgagtgcagtggaacatgaaaaacttgaggagataacagttgaggtgggtttccatagatgcataatagttcaagagcaagatttggtggggaggcactattcaagacagggactaagttcaaaatccaagacgtatgctgggacacacctctgacaggttggcataaaggaggcttaatcaaactatttttcttcttctgaaacagaagcaataattttcatttacatttgacatatcccgaggtaatattaacattagggaaagttactcttttccatctttccacattcttgcaggaccataaaatctgaattttccagtatttttaataagagggaagaaacctctctttttcttctctttttcatctcccaagagatcctcctctcatgactacagttgaataggtggtttctattggaagacattcaggaattcaaggtgcatgtccataaatggactttttttgttgttgttcagagctggaccttgaatgatgcatccttctctctgttgtaaccatgaataatgcacccttcatgctatagcctttaacgattcacccttcttattgtaaccttgaatgattcaccctttatggtgtagccttgagtgacgcacccttcatgttgtagccttcaatgatgcacactccatgttatagccttgaatgatataccctttatgctgcagcctttctcttatggggaaaagcctgcagatatcctgctgcttaactgacaagtgtggtgagaaataagtagaaatctaaagaggggaagaccattttggacacttatctgcaaggcagatccaacacacttttccagtagtcaagctacttctaattttgttcagtatcaaaatgagaaacaggcctgattctccagcactcttgtcaacacaacttccccccatatttatatatatacacacacatatatatctttatatatatacacacatatatatctttatatatatatatttatatatatatctttttgcatatatacatatatatgtatctttatttcctttgaaataaagataaatatagctgatttctttggcttcgacacttactatttgcatgactaagggaagctagttaacctttctgtgactcatttccttgtccataaaatgggaatattaattgtacatgtcttatggattggtgtgtgaattcagttagcgagtgtagaatataacttatagatcaaagtagagtaaatggaaagggctcaactatggtgttgctactgccattgttattacaggcacacagttcgagctataatcatttcaagggaaattcttatgtgtcagttctggatcgaggtctgagattctgcatttcaaacaaacttccaggaatgctgctgcttcttggtccacacttggagaaataagtcagcagagagtcctctcgtttcctattgtaccatgtctgtcttttgtctcctgcttattggcctctgtaaggaactcacagctgctataataaagtaccaaaaactgggtggcttaaaacaacagaaacttactttctcacaattctggaggctaaaaattcaaaatcaaggtgtcagcagggtcagattccttccaaagcctttaggagaggacctttccttgctcctcctaggtttctggttaaatctaggtgttctttgccttatggcagcgtgactctaatttatgcctccatcttcaccctcacatggccttctctctcatgtgtttgtgtcttttctcttcttcttctatgaacatgagttatattggattaaggctcaccctaatttagtatgaacccatcttaacttgattatatctgcaaagactctatttccaaatgaagtcagactcacaggtattgggggtttgatattgaacatatcttctgggaggagacacaacttaatcattaatatccactttcttttttccttattaaatgtttaatttttttgttttcattaaaactgttgttcgattatgggtgcttcacataaaaggttggaaacttaaaaatttgtctctgacccctcctggttggaaaggcctctgttgtacatttatgctagcctaggccataccactttctgtcttcagtacagccatcttagtttattcaagtgacacagattttccagaacacagtattcatgatcttttaaagcatttttcttcaaagactttgatctggcaataaatgttactatgtaattctcatgacataaattaggcataacttggatctcctcttcttctgctcattcatttgtctgaatcatcactattatcttttttatattcctttaccgttctccataatgcttttccaagaaactggtttattccacaattttattgcagaggcagctgcaggatatcataatcttatctttatacgaaggaagaattgcctaatccctcaagtaaactaaaaatgttttatacagtcatttctcattcatccaatgttccaggcagtcccagtccaagactgccccttcacacacacaacaactcttcacaagacttcactgtccttcagactctcctgcagcacagacattcgaggttgctgagtcgacattgcagttatttcactcttgattttgctgctcaattttaagtttccacacttattgctaaaacattccttctagtggatctgtttatgtattcaagcacaccatctgtcacaattatttcaaatcacaggtctgtgacagactgtcaatttcacaccacaaagtataatagtggaaaacaaagtaaaatcaagaaagggagaacactaaacttattaaaaccatatacaagcatacgcattcaggaaactaaaacaaccttcaaagaagttgaacaattttgagccaaaagaaagggcatatgcacaccctaccccagtataagataaccagaaaaggactgggtgagttgcctcctgagtattatgactgccatcaatcacttaggcattggagatcaggagactcttcccaggccacacattctgcagtgactgtgagggctgaatgaatgcttccaggccatcaggaacaagcatagaaacacaaatcaattttaaaatacactcaaaaatgtcaaaataatccaacttttttgtcttgatcagatatatctactagcacatattacttcattttttcagccaatatttattaataacctactgtgtgcttgacagtgttctagtggcagagacacagcagtgcataatgccttgccctctgaagcagatgttgcagcaggaggagacattccaggacatgacaattaaagtggaggaatgtcaagcagaactggggaataagggatgtgaagggggtgagacttgctattttatataggatggtcggaaaaaggacttatcaggagtgacatttgagcagggagatgaagaactgaagggagcaagccaagaaaagaggccctgaatttggaaaatacatggcacgttccaacaagagcagagaggacaaacgtgagcagagtaaagtgagcaagaagagataatatatgatacaaggtcagaaaggtaatgacaatcgcatcctgtaggactttttaggccattgtaaagatgagcttttactctgagtaagacagagagctattagaggggtctcggtagaggagtgacttgattcaactgtctttgagaggatccctttgcgtgtatagactgtaaggtaacaggaataggccaagagagaatatttcggatgctagtgcaataatcaggtgagagatgatgaagactttgacctggataatagtagaaaaattgttgagaagggatcaaaatatggggtttgttttgatggtagagaggccagggatggctgaatgatcagatggggcatgagagagaaagaaaagaaacagagatgacttcaggaattttggcctgggccactggaaggatgaagtcaccatttactgagatggtaatgactgggaggttgagctggaagaactgagaatcaaatatctggttttgaatctgttctttttgagatgcatattcaacttccatatggaggtgtcaaggaggatttagatctagaattttggagctcaagggaaagggttgagctgtagacataaattctagagatgccggaatatagattgtgatccttctttatcagcacagaaatgacttgactttgtccaaactaagcaatcatactgtacatgttagcaacacattttacagggccaatttggccttttgcaatgttctgtggtttctaagataaataaacatattatatgtttccctctgga

SEQ ID NO: 125793 - DNA, 2133 bp, Homo sapiens
  Payload ID: 4647
  Gene Symbol: DCN
  Gene Name: decorin
  Uniprot ID: P07585
  ENST ID: ENST00000393155
  CDS Start-End: 255-1334
ggaataataagacacgccctgaaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtg

SEQ ID NO: 125794 - DNA, 228 bp, Homo sapiens
  Payload ID: 4647
  Gene Symbol: DCN
  Gene Name: decorin
  Uniprot ID: P07585
  ENST ID: ENST00000456569
  CDS Start-End: 1-228
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggttgtctaccttcataa

SEQ ID NO: 125795 - DNA, 519 bp, Homo sapiens
  Payload ID: 4647
  Gene Symbol: DCN
  Gene Name: decorin
  Uniprot ID: P07585
  ENST ID: ENST00000441303
  CDS Start-End: 1-519
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaa

SEQ ID NO: 125796 - DNA, 1438 bp, Homo sapiens
  Payload ID: 4647
  Gene Symbol: DCN
  Gene Name: decorin
  Uniprot ID: P07585
  ENST ID: ENST00000425043
  CDS Start-End: 1-639
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtg

SEQ ID NO: 125797 - DNA, 753 bp, Homo sapiens
  Payload ID: 4647
  Gene Symbol: DCN
  Gene Name: decorin
  Uniprot ID: P07585
  ENST ID: ENST00000420120
  CDS Start-End: 1-753
atgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaa

SEQ ID NO: 125798 - DNA, 586 bp, Homo sapiens
  Payload ID: 4647
  Gene Symbol: DCN
  Gene Name: decorin
  ENST ID: ENST00000546370
  CDS Start-End: 112-378
agcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggtagagacggggtttcaccgtgttagccaggatggtctcgatctcctgatctcgtgatccacccgcctcggcttcccaaagtgctgggattacaggcgtgagtcaccgcgcccggcctcaatatgtcttctaatcttaaagataaagaagaggaaccagaattgaaattcacataacagtcttataaaaaaatgttattataggagcatgtttaaatatgaaaattctgcagaataaaatgaccccattgggtacccaccacaga

SEQ ID NO: 125799 - DNA, 716 bp, Homo sapiens
  Payload ID: 4647
  Gene Symbol: DCN
  Gene Name: decorin
  ENST ID: ENST00000546391
  CDS Start-End: 186-716
tgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttat

SEQ ID NO: 125800 - DNA, 1930 bp, Homo sapiens
  Payload ID: 4647
  Gene Symbol: DCN
  Gene Name: decorin
  Uniprot ID: P07585
  ENST ID: ENST00000552962
  CDS Start-End: 529-1608
attttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaagactgattgcttggaacaaatggaataaatcgtcttgtcaataaagtgatggtcaattgagtcatttgtgtgcaaaatattgtgcaaggcccgggtacagaacaaggaataataagacacgccctgaaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttcca

SEQ ID NO: 125801 - DNA, 823 bp, Homo sapiens
  Payload ID: 4647
  Gene Symbol: DCN
  Gene Name: decorin
  Uniprot ID: P07585
  ENST ID: ENST00000547568
  CDS Start-End: 185-823
gagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtcttcctccttcccttacggaattacatcttgatggcaacaaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaa

SEQ ID NO: 125802 - DNA, 648 bp, Homo sapiens
  Payload ID: 4647
  Gene Symbol: DCN
  Gene Name: decorin
  ENST ID: ENST00000552145
  CDS Start-End: 113-648
atggttttcaataattgtcctgaactctgctacagactaataaaacttcggtcaagttgcgagcaaaagggattatttggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcat

SEQ ID NO: 125803 - DNA, 719 bp, Homo sapiens
  Payload ID: 4647
  Gene Symbol: DCN
  Gene Name: decorin
  ENST ID: ENST00000550099
  CDS Start-End: 168-464
gttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggaaaagaagtattgcaataatttatcttcgtacaacctctacacaacaaactgccttatactttgtagactctttacacatcactgaacgattgatgaatgaatacacgaacatatgcatggcttggttcttgaattaatgcttggatgaatattctacaatattcttgactctagcaagctgcaaagagaagggaacatgcctgattgagaaacaaaagtgatttctcagtgcatccttgctccttccctttaaggacaactgtaaaaccaggaagcttagaaattccttgagtttgactggaaagagaatagaattaaagagaagaatcatctatgtatg

SEQ ID NO: 125804 - DNA, 2924 bp, Homo sapiens
  Payload ID: 4647
  Gene Symbol: DCN
  Gene Name: decorin
  ENST ID: ENST00000551354
  CDS Start-End: 206-508
accaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggaaaaatttggtctggaaattccaagagcattacacttagaagataaatctccagaaagattgaagctcagtggatgggccaaaggggaatgaactcagtttacatggcagctcattcacattcctccttttgaaggggtgtattttcttactggagatgaaaagaaaaaaaaatctttatatcatgattccgccatgtgtacttccttctggaagaaattccatactatgatcaggcacttctttcagaagtcctatatttactcagaacatgctttctagcagtagtttgcagaagaaaaatgcaacttctacaattggaataaactgcctataggaacccagaaaaaatataaagtatattcagtagtaacgactgaaaaacacttgaaatagcttcttcaacacatatattgtatagctatttaaaacccaaatacaaatgttatatgaagactttcaaaaggccgcaggataattccaatggatctatttgttcagtcattcagaagctatatcgggaacccatcatggatgagctctgctctaggcatggggagaaaggatgaggaagacaaatatggccctagttcttgtggatcttatgttctagtggtggtgactattactttttgaattgtgtatttgccacaggggagattggattactcttcagaaattttataagcatctagagatgacctgcattattgccttgggcaggaaaataacagggttgaaaaaaatctgaacaaagaaatcaccatttgatggatatacacaggataatcttttctgaagttactaaaatggcgaagttcccaaaaaatgtaatgcgaattaaatttcactttgcctctgagaaaaagttaaaagaatttattattactctcgctacatgtattatcaaaaatgaagggttgatatttttaaggaaagaagagttggccagtcactttagtgaagttttattttttcgtaaatatagtttgcctttgcttccatgaaaaaatagctcataaaccttgaccctgatgaaagcactgggccagttttccaattctctgttatgtaaaaaggcataagtcaattgttcaaagtgaaacaacaacaacaacaacaaaatgtagtcttaggaagcagcaagttcactgacttgggatctttatgacagttttgttgttgccattgatattgttttgtttattttttgttttcagatgagaaagttttctacatgttatcttttttctaggagctcaaagtgtacatcattcctttattatagctaggtttactgactcatatactaaggaagtagctaaaattataaaaataatttgtttttaaaaccatatttaactaagggaactaagtaagttccaatgagcagtggtctcatgcaaggtattttcaatattttaaaatttacagatgaatatttaaatatattataaaagttttaatcagctatctctaagaaaatacatttcttaaagggaaatgaaattcacttgactttaaataaaacaaatgaactcatttcatgtttttaactattatctaactcttccttactttatgatgctggcaagctgttgagagccttgacatctccatctgcagaaaaatcacagtcttagaaatcctattaatcgtgtgaggtacctgggtcatagtagcagcttcatgcagtgttaaaattatatgatgattatatgcagtaacagatgaagaaaaaaagaaagaaagcaggagaaatgcaccacctcattcattgtaaatgcagtatagttgattttttaatttgttttatgtcctctagtgatctaagcatgaagcttgaattattataataaagaaaataaatgcaatgcagttggggatggcaaatgttaatgcttatctgtatcaaagactaacactgtcttcaggattatccttggtggattatccttggcagacacttaatgagcagagagaagctacaatgttgaaggacaaaagtcctttgtcatcttattatcgaaataatgtttaatacaaataaactttttaaattaaaatgtttgactactttttaccactaagaaatattcttggcaaagttaaacaacatcaaaattttaaacaattctttcaaagctaagaagtaaaaacctatgaaattaaaattatgtaattactctgcaggataatttgatgcctctggaaaaatgcatggactgttttagtccctaattctaatttatcacagtagtattaacacgtgcttttttttttttttaagaggatgagggattgagacagtaaacatgaattcctcatagatattggccaagttgtttcattgaacttgttgcaacttaccttgtaattggaaccacaattttatgagacccatatcttgtcttcttttatctatcatgttaagaaataaaccagttccctcttaattatagcatttatttcaaaaagcaatgttaaaaataaatgtagagttagcaaa

SEQ ID NO: 125805 - DNA, 356 bp, Homo sapiens
  Payload ID: 4647
  Gene Symbol: DCN
  Gene Name: decorin
  ENST ID: ENST00000548218
  CDS Start-End: 1-157
tgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaatta

SEQ ID NO: 125806 - DNA, 1026 bp, Homo sapiens
  Payload ID: 4647
  Gene Symbol: DCN
  Gene Name: decorin
  ENST ID: ENST00000546745
  CDS Start-End: 89-385
agtgtaattacatctcagctttgagggctcctgtggcaaattcccggattaaaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttggaaaagaagtattgcaataatttatcttcgtacaacctctacacaacaaactgccttatactttgtagactctttacacatcactgaacgattgatgaatgaatacacgaacatatgcatggcttggttcttgaattaatgcttggatgaatattctacaatattcttgactctagcaagctgcaaagagaagggaacatgcctgattgagaaacaaaagtgatttctcagtgcatccttgctccttccctttaaggacaactgtaaaaccaggaagcttagaaattccttgagtttgactggaaagagaatagaattaaagagaagaatcatctatgtatgaagcctggtctaactgataacgcagtcagattgccatttttaagatggaaaaaggggaacatgcttgccttgagcagaaaagtttttggtggggctggagctcctaaatattattttggtcatttgcccaaaaactgaagtacaccaccaatgtcccaattatgaagttgaatacagaattataaaaaaaaattgttgaaagtcaataagaataaatcttagaatttggactcctgccacatggcagaaaaaaagcatgatgttttaagacaacctggcctttgtccaacatgatgtttaccagattgctgacattttctagcataacaatactattcatcattgggataaccaaaagaagggaaataaaaaaaaaaagaagtcta

SEQ ID NO: 125807 - DNA, 593 bp, Homo sapiens
  Payload ID: 4647
  Gene Symbol: DCN
  Gene Name: decorin
  ENST ID: ENST00000550563
  CDS Start-End: 72-593
attctacatggcaagtagctttgattgtcagggttcaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaac

SEQ ID NO: 125808 - DNA, 1064 bp, Homo sapiens
  Payload ID: 4647
  Gene Symbol: DCN
  Gene Name: decorin
  ENST ID: ENST00000550758
  CDS Start-End: 1-286
caaaatcagcagagttgatgcagctagcctgaaaggactgaataatttggctaagttgggattgagtttcaacagcatctctgctgttgacaatggctctctggccaacacgcctcatctgagggagcttcacttggacaacaacaagcttaccagagtacctggtgggctggcagagcataagtacatccaggtaatgcaaagccactgcttatgtgaggaatatccaaaaagcaagacccccaccctgcttatgggatgctgggaagcaggaagctcttcttagaagttttttttccagagtgtcttagttagaatttctatgacaaaataccataaaaaaaattaaatcatgaagcacaatttacattagctagatttcaataaagtttttgatttagaagtatggagatgaaacttaaagtcttctgtaatgctgatatttttttcagtaggggtggtgatgttggtgccatagtgagtagggggagtttgaagccacaagtaaaataaaaattctttttttttactgtcactaattttaattttcaaattattcaagaattgactggaaagagcttctttggtctagctcctgattctttttgacatggcctcatcatttttctttatttcctctaaaaaaaaaatgagatacgtttgcagaatgtgcaggtttgttatataggtatacgtgtgccatggtggtttgctggccctactgacccatcctctaagttcgcccgctcaccccctaccccctgttgtgtgttttgttaccctctctgtgtccgtgtgttctcagcattcaacttccatttatgcgtgagaacatgcagtatttggttttctgttcctgtgttagtttgctgaggatgatggcttctagtttcatccatgtccttgtaaaggacatgatcccattcctttttatggctgcatagtattccacggtgtatatgtaccacatttcctttatccagtctatcattgatgtgcatttggattggttccatgtttttgctattgtaaaatagtgctgcaataaacattatgtgtgcata

SEQ ID NO: 125809 - DNA, 920 bp, Homo sapiens
  Payload ID: 4647
  Gene Symbol: DCN
  Gene Name: decorin
  ENST ID: ENST00000549513
  CDS Start-End: 563-920
aacattttctttttgtgggttgttagtgaaacaaccaggcatgttctgctctggagaaaagatttcaaagtgacatctgcattaactgtcgttgctatttattaaatctgcaatgactttgcttcatttttcttttaaacttgtaagacattaaatatgcaaggctagcaagcttgtggtaaaccataaacattgcatttttaatgggaaacagatacaaaaccactccctcagatacaatccaaaggaacaggctgccaaaacaaaagtcttctcttaaagggatactcagtaactgaatgagagtgggctgctagaagaagcttaatgttgaacttaaagtggcagtgtgaataataatctttatgatattttgttaaatgaaaagccacaagcctgtattcaacatgtgctgccttagacacatatcagtagtaaatataaactaagaacaaacatgtaagaaactgaaaaacatttgtttcttctctagagaatctaggcaaaaattcccagaagataccttaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaag

SEQ ID NO: 125810 - DNA, 750 bp, Homo sapiens
  Payload ID: 4647
  Gene Symbol: DCN
  Gene Name: decorin
  ENST ID: ENST00000547937
  CDS Start-End: 213-750
tttctttttctctttctttctttccttttctttcttccttctttctttctttcttccttccttctttctttcttcttttttttaatatgctacaattggataatgactcaaaacagctgtaagattctacttacgaacgtacagctttaatatggattcgtctaagtgtacaattcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatag

SEQ ID NO: 125811 - DNA, 6797 bp, Homo sapiens
  Payload ID: 4648
  Gene Symbol: DOCK1
  Gene Name: dedicator of cytokinesis 1
  Uniprot ID: Q14185
  ENST ID: ENST00000280333
  CDS Start-End: 110-5707
ctccgccgcaaactttttcctccccatcctgtcgcggctcgaaaggaatggaaaatggcggcctagacgcggagtttcctgcccgacccgcggcggctccggcggcgccatgacgcgctgggtgcccaccaagcgcgaggagaagtacggcgtggctttttataactatgatgccagaggagcggatgaactttctttacagatcggagacactgtgcacatcttagaaacatatgaagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagatataataaatggaaaagtagatgatgaagataagcagcatttcattccctttcagccggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcaaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccattgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcaggcatcggtggactccgggatcgtgcagtgacgtcgcaagcctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgctatcgtagttatcagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttaggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttccgtttattataataggcgtccaccaatgattatccatatgtgttcttaatttttaactgctggaagtgttaaaacacacacacacacacacacacattttttttttgagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaagac

SEQ ID NO: 125812 - DNA, 5761 bp, Homo sapiens
  Payload ID: 4648
  Gene Symbol: DOCK1
  Gene Name: dedicator of cytokinesis 1
  ENST ID: ENST00000623213
  CDS Start-End: 63-5723
atggaaaatggcggcctagacgcggagtttcctgcccgacccgcggcggctccggcggcgccatgacgcgctgggtgcccaccaagcgcgaggagaagtacggcgtggctttttataactatgatgccagaggagcggatgaactttctttacagatcggagacactgtgcacatcttagaaacatatgaagggtggtaccgaggttacacgttacgaaaaaagtctaagaagggtatatttcctgcttcatatattcatcttaaagaagcgatagttgaaggaaaagggcaacatgaaacagtcatcccgggtgacctccccctcatccaggaagtcaccacgacactccgagagtggtccaccatctggaggcagctctacgtgcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacagaattctagatttggacctggtggttagagatgaagatgggaatattttggatccagaattaactagcacgattagtctcttcagagctcatgaaatagcttctaaacaagtggaggaaaggttacaagaggaaaaatctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcagtgagaactacctggttcgctggtccagttcaggattacctaaagacatagacagattacataatttgcgagccgtgtttactgacctcggaagcaaagacctgaaaagggagaaaatcagttttgtctgtcagattgttcgcgtgggtcgcatggagctgagggacaacaacaccaggaaactgacctcggggttgcggcgaccttttggagtggctgtgatggatgtaacagatataataaatggaaaagtagatgatgaagataagcagcatttcattccctttcagccgctcgcgttggacgacgccattcgacacaagccgctgaacatgtcatcccgtttttcacccagggtggcaggggagaatgacttccttcagactgttataaacaaagtcatcgctgccaaagaagtcaaccacaaggggcagggtttgtgggtaacattgaaattacttcctggagatatccatcagatccgaaaagagtttccgcatttagtggacaggaccacagctgtggctcgaaaaacagggtttccggagataatcatgcctggtgatgttcgaaatgatatctatgtaacattagttcaaggagattttgataaaggaagcaaaacaacagcgaagaacgtggaggtcacggtgtctgtgtacgatgaggatgggaaacgattagagcatgtgattttcccgggtgctggtgatgaagcgatttcagagtacaaatctgtgatttactaccaagtaaagcagccacgctggtttgagactgttaaggtggccattcccatcgaggacgttaaccgcagtcaccttcggtttaccttccgccacaggtcatcacaggactctaaggataaatctgagaaaatatttgcactagcatttgtcaagctgatgagatacgatggtaccaccctgcgagacggagagcacgatcttatcgtctataaggccgaagcaaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacgtggaccttctggggctcttgaaatggcgctccaacaccagcctgctgcagcagaacttgaggcagctgatgaaagtcgatggtggtgaagtagtgaagtttcttcaggacacgttggatgccctcttcaacatcatgatggagaactcagagagtgagacttttgacacgttagtctttgatgctctggtatttatcattggactgattgctgatagaaaatttcagcattttaatcctgttttggaaacttacattaagaaacactttagtgcaacgttagcctacacgaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcaactgtatgaaaacaagggagaggctgacttcgtggaatctttgctgcagctcttcaggtccatcaatgacatgatgagcagcatgtcagaccagaccgtccgggtgaagggggcagcactgaaatacttaccaacgatcgtcaacgatgtgaaattggtgtttgatcccaaagagctcagcaaaatgtttactgaattcatcctcaatgttcccatgggcttgctgaccatccagaaactctactgcttgatcgaaatcgtccacagtgacctcttcacacagcatgactgcagagagatcctgcttcccatgatgaccgatcagctcaagtaccatctggagagacaggaggacctggaggcctgctgtcagctgctcagccacatcctggaggtgctgtacaggaaggacgtggggccaacccagaggcacgtccagattatcatggagaaacttctccggaccgtgaaccgaaccgtcatttccatgggacgagattctgaactcattggaaacttcgtggcttgcatgacagctattttacgacaaatggaagattaccattatgcccacttgatcaagacttttgggaaaatgaggactgatgtggtagatttcctaatggaaacattcatcatgtttaagaacctcattggaaagaacgtttaccccttcgactgggtgatcatgaacatggtgcaaaataaagtcttcctgcgagcaattaatcagtatgcagatatgctgaacaaaaaatttctggatcaagccaactttgagctacagctgtggaacaactactttcacctggctgttgctttccttactcaagagtccctgcaactggagaatttttcaagtgccaagagagccaaaatccttaacaagtacggagatatgaggagacagattggctttgaaatcagagacatgtggtacaaccttggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatgtttgaaaatgagatcatcaccaagctggatcatgaagtcgaaggaggcagaggagacgaacagtacaaagtgttatttgataaaatccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctgaatttctacaaagaaattgaaagagaagaaatgtatataaggtatttgtacaagctctgtgacctgcacaaggagtgtgataactacaccgaagcggcttacaccttgcttctccatgcaaagcttcttaagtggtcggaggatgtgtgtgtggcccacctcacccagcgggacgggtaccaggccaccacgcagggacagctgaaggagcagctctaccaggaaatcatccactacttcgacaaaggcaagatgtgggaggaggccattgccttgggcaaggagctagccgagcagtatgagaacgaaatgtttgattatgagcaactcagcgaattgctgaaaaaacaggctcagttttatgaaaacatcgtcaaagtgatcaggcccaagcctgactattttgctgttggctactacggacaagggttccccacattcctgcggggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtatattcagtgcttcacagtgaagcccaaactcgatctgcctcctaagtttcacaggccagtgtcagagcagattgtaagtttttacagggtgaacgaggtccagcgatttgaatattctcggccaatccggaagggagagaaaaacccagacaatgaatttgcgaatatgtggatcgagagaaccatatatacaactgcatataaattacctggaattttaaggtggtttgaggtcaagtctgttttcatggtggaaatcagccccctggagaatgccattgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggccttctttacagaccggtacctgcaggagcaccctgaggcccatgaaaagatcgagaagctcaaggacctgattgcttggcagattccttttctggccgaagggatcagaatccatggagacaaagtcacggaggcactgaggccgttccacgagaggatggaggcctgtttcaaacagctgaaggaaaaggtggagaaagagtacggcgtccgaatcatgccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacgataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagcttggagctgaacggcatgacgggggcggacgtggccgatgtcccaccccctctgcctctcaaaggcagcgtggcagattacgggaatttgatggaaaaccaggacttgctgggctcgccaacacctccacctccccctccacaccagaggcatctgccacctccactgcccagcaaaactccgcctcctccccctccaaagacaactcgcaagcaggcatcggtggactccgggatcgtgcagtgacgtcgcaagcctctctggaaagagtgtgctgcccctcc

SEQ ID NO: 125813 - DNA, 7260 bp, Homo sapiens
  Payload ID: 4649
  Gene Symbol: DOCK10
  Gene Name: dedicator of cytokinesis 10
  Uniprot ID: Q96BY6
  ENST ID: ENST00000258390
  CDS Start-End: 69-6629
aaggttggcgcggggaagaccggcgggaggcgcgccccgggcccgcggcgcgattggcgtgaccggcgatggccggtgagcggacccgcaggttcacccggagcctgttgagacctgggcaggcggccgagctccggcacagcgccgcgtccgccgccgcggtggcagtcagcagccggcagcagcagcggcaagaaaagcctaggcttctcgagcctttggattatgagactgtcattgaagaacttgaaaagacctaccggaatgatcctcttcaagatctcttgttcttccccagtgatgacttttcagcagccacagtttcctgggatatccgcacgttgtactcaacagtacctgaagatgcagagcacaaggcagaaaatttactggttaaggaggcttgtaaattttatagttcccagtggcatgtggtaaactacaaatatgaacaatattctggagacattcgacagctaccccgagcagaatacaaaccagagaagcttccttcacattcctttgagattgaccatgaagatgctgataaggatgaagataccacttcccactcgtcttccaaggggggtggaggagcgggaggaactggtgttttcaagtccggctggctctacaaggggaattttaacagcaccgtgaacaacaccgttactgttcggtcattcaaaaagcgctacttccagctgactcagttaccagataactcctacattatgaacttttacaaagatgagaaaatatccaaagaacccaaaggatgcatctttttggattcctgtacaggagtggtgcagaataacagactaagaaaatatgcctttgaattgaaaatgaatgatctgacctattttgtgctggcagctgaaacagagtcagatatggatgaatggatccacaccctcaaccgcattctgcaaatcagtcctgaggggcccctccaagggaggaggagcacagagctcactgatctgggtctggattcgctggataattctgtaacttgtgaatgcacgccagaggaaacagattcttcagagaacaacctacacgcagactttgcaaagtacctcacagaaacagaagatactgtaaaaacaactcgaaacatggagaggctaaatctgttctctctagatccagacatagataccttgaaacttcaaaaaaaagatctcttggaacctgagtctgtgatcaaaccatttgaagaaaaagctgccaagagaatcatgatcatctgtaaagccctcaactcaaatcttcagggatgtgttacggagaatgaaaatgatccgataacgaatattgagcctttttttgtgagtgtggcactttatgacctcagagacagcaggaagatttctgctgattttcatgtggatctaaaccatgctgctgtcagacagatgctcttgggggcttctgtggctttggaaaatggcaacatcgacaccatcactccaagacaatcagaagaacctcacatcaagggacttccagaggaatggctaaaatttccaaagcaggctgtattttctgtaagcaatccacattctgaaattgttttggtggccaaaatcgaaaaagtcttgatgggaaacattgcaagtggtgccgaaccttatattaagaacccagactccaacaagtatgcacaaaagatactaaaatccaacagacaattctgcagcaaattgggaaaataccgtatgccttttgcttgggcagtaagatcagtatttaaggacaaccagggaaatgtggacagagactcaagattttcaccattgtttagacaagaaagtagcaagatttcaactgaggacctagttaaactagtatcagattatagaagggccgacagaataagcaaaatgcagaccattcctggaagcctggatattgctgttgacaacgttcccttggagcatccaaattgtgtaacatcgtcctttatccctgtcaagcctttcaacatgatggctcaaacagaacccacagtggaggtggaagaatttgtttacgattcaacaaagtattgtcggccttacagagtatataaaaatcaaatttatatttaccccaaacacctcaagtatgatagccagaaatgcttcaacaaggcacggaatataactgtgtgcattgaattcaaaaattcagatgaagaaagtgccaagcccctgaagtgtatttatggaaaacctggagggcccctcttcacctcagccgcctacacagcagttctgcaccactctcagaatccggatttctcagatgaggtgaaaattgagctaccaacacaactccatgagaaacaccatattttgttttctttttatcacgtcacctgtgacatcaatgcaaaagctaatgccaaaaagaaggaggctctggaaacgtcagttggatatgcttggcttcctctgatgaaacacgatcagatagcttctcaagagtacaacatcccaatagcaacaagtctgcctcctaattatttaagctttcaagattctgcaagtggaaagcatggtgggagtgacattaaatgggttgatggtggcaaaccacttttcaaagtgtcgacatttgttgtatcaacagtaaatactcaggatccacatgtgaatgcatttttccaagagtgccaaaaaagagagaaagatatgtctcagtcacctacctcaaatttcatccgctcttgtaagaacttattgaatgtggaaaagattcatgcaatcatgagttttctgcctataattttgaatcagctcttcaaagttctggtacagaatgaggaagatgaaataactacaactgtcaccagggttctgaccgacattgtggccaagtgccatgaggagcagctggatcattctgtccagtcatatattaagttcgtgttcaagaccagggcatgcaaggagaggactgtacatgaggaactggctaaaaatgtgactggtcttttgaaatcaaatgactcaacaacagtaaagcatgtcctaaagcattcctggttcttctttgcaattatcctaaaatcgatggcacagcacttgattgacacaaataaaatccagcttccccggcctcagagatttcctgaatcttaccaaaatgaattggacaatcttgtcatggtcctatccgaccatgtgatttggaaatacaaggatgcacttgaagaaacaagaagggcaaaccacagcgttgccagatttctcaagcgctgctttacatttatggaccgagggtatgtgtttaagatggtcaacaattacatcagcatgttctcctccggtgaccttaagaccttgtgccagtataaatttgattttcttcaagaagtatgtcaacatgaacactttatccctttgtgtctgcccataagatcagcaaacattccagatcctttgacaccttcagaatcgactcaagagttacatgcatcagatatgcctgaatattcagtcacaaatgaattttgtcgcaaacacttcttaatcggaattctgctccgagaagttggctttgccctgcaggaagaccaagatgtcagacacttagctttagctgtcctaaaaaatctaatggctaagcattcatttgatgatcgatacagagagccaagaaagcaggcccagatagcaagtttatacatgcccctgtacggcatgctcctggacaatatgccaaggatttatctgaaggacctgtatccttttactgtcaatacatctaatcaggggtctagagatgatctaagcaccaatggaggatttcaaagccagacagctatcaaacatgcaaactctgtggatacatcattttctaaagatgttttaaattccatagcagcattttcatcaatagctatttctacagtaaaccatgctgactccagagcatctttagcaagtcttgactccaatccaagtaccaatgagaagagcagtgagaagacggacaactgtgaaaagatcccaagacccttgtctttgattggctcaactcttcgatttgacaagttagatcaagcagaaaccaggagtctcctgatgtgttttcttcacattatgaaaacgatttcgtacgagactctgattgcctactggcagagagctcccagcccagaggtgtccgacttcttcagcatcttggacgtttgtcttcaaaatttcagatacctaggaaaacgcaacataataagaaaaattgctgctgcatttaaatttgtgcagtccacccagaacaatggaactctcaaaggatccaatccttcctgccagacatcaggtctcttgtcacaatggatgcactccacttccagtcatgaaggccataagcagcacagatcacaaactttacctataattcgaggcaaaaatgcactttctaaccccaaactcttacagatgttagacaataccatgaccagcaactccaatgaaatagacatcgtgcatcatgtagacactgaggccaatatagctacggaggtttgcctcactattctggacctgttatccctcttcacacagactcatcagagacaactccaacaatgtgactgtcaaaattcattgatgaaaagggtctttgatacctacatgctctttttccaagtcaatcagtcagccacagcgctgaagcatgtgtttgcctccttgagactgtttgtatgcaagtttccttcagcgttctttcaagggcctgctgacctctgtggatcattctgttacgaagtcctaaaatgctgtaaccacaggtcacggtcaactcagacagaagcctcagcccttctgtactttttcatgaggaagaattttgaatttaacaagcagaagtcaattgtccggtcccacttacaactcatcaaagctgtgagccagttaatagccgatgctgggattggaggctctcggtttcaacattcgcttgcaattaccaataatttcgccaatggagataagcaaatgaaaaacagcaatttcccagcagaggtgaaggacctgactaagcgtataaggactgttttgatggccacagctcagatgaaggagcacgagaaggaccccgagatgctggtggatctccagtacagcctggcaaactcctacgcaagcactcctgaactacgcaggacctggctggaaagtatggccaagattcatgccagaaacggagatttatctgaggctgccatgtgttacatccatattgctgctctcattgcagagtatctgaaaagaaagggttactggaaagtggaaaagatttgcacagcatccctgctctcggaggatacccacccctgtgatagcaactcattactaacaactcccagtggaggaagcatgttctctatgggatggccagcttttttgagcattacaccaaacattaaggaagaaggagcgatgaaagaggattctggaatgcaagatacaccatacaatgagaatatcctggtggagcagctatacatgtgtgtggagtttctctggaagtctgagcgatatgaactcattgctgatgtcaacaagcccatcattgctgtctttgagaaacaacgagacttcaaaaaattgtcagatctctactacgacattcatcggtcatatctgaaagtggcagaggtggtgaattcggagaagcggctgtttggtcgctactatcgtgtggcattttatgggcagggcttttttgaagaagaagaaggtaaagagtatatttataaagagcctaagctgacaggtctgtccgagatttcccaaagattactcaagctctatgcagataaatttggagcagacaatgtgaagataatccaggattccaacaaggtaaaccccaaggatttggaccccaaatatgcctacatccaggtgacctatgtgacgccgttctttgaggaaaaggaaatcgaagaccggaagacagatttcgaaatgcaccacaacatcaaccgctttgtcttcgagacacccttcacgctgtcgggcaagaagcacggtggggtggcggagcagtgcaagcggcggacgatcctgacaacgagtcacctgttcccctacgtgaagaagagaatacaagtaattagccaatcgagcacagaactgaatccaattgaagtggcaattgacgagatgtccaagaaggtttctgagcttaatcagctttgcacaatggaagaagtggacatgatcagactgcagctcaaactgcaaggaagtgtcagcgtgaaggttaatgctgggccaatggcctatgcacgagcttttcttgaagaaaccaatgcaaagaagtaccctgacaaccaagtaaagcttttgaaggagatcttcaggcaatttgcagatgcatgtgggcaggcccttgacgtgaatgagcgcctcatcaaagaggaccagctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctctgaatttgcacattttgtataatttttttttctttgagcagtgttgatcaagccaggttgaatatttgccatgaaattccagtgaatgtgtagctcaaatgcaaaccctaagtttgctgtcagttattgtatggtcagtaccccagtcctagtacacatattttaaaggttaaagtgaatgtttttgtaacatttaagcatatttcagatgtaaataaaagattgtaaaatatacggtttttaccaaatttaaaagatcctttttagttaatactatgacagtactaaaaatatatgaataacatttcagataccattatattaaaatatttgtgtatgtgtacaaaagcgttgataaatactaatctttaaagtttgtggagttcctttatttgtaatatatgtgctcttaaaagcaatgggatgtgaaattatgaaagtattttattgttcatagaaataaaaaacacagttactttgca

SEQ ID NO: 125814 - DNA, 7288 bp, Homo sapiens
  Payload ID: 4649
  Gene Symbol: DOCK10
  Gene Name: dedicator of cytokinesis 10
  Uniprot ID: Q96BY6
  ENST ID: ENST00000409592
  CDS Start-End: 115-6657
atttccctttttaccaagaagaaagatttgttcagcctggtgacgcttcagaagagaagagtttaacgacattgatattttgaaatattttgtgactcaaattatagcaatacgatgagttttcgagggaaggtttttaaacgggagcccagtgaattttggaagaagagacgaactgtgaggagagtaaaccaagaagaaatccacagatttagttctcaagaaaagcctaggcttctcgagcctttggattatgagactgtcattgaagaacttgaaaagacctaccggaatgatcctcttcaagatctcttgttcttccccagtgatgacttttcagcagccacagtttcctgggatatccgcacgttgtactcaacagtacctgaagatgcagagcacaaggcagaaaatttactggttaaggaggcttgtaaattttatagttcccagtggcatgtggtaaactacaaatatgaacaatattctggagacattcgacagctaccccgagcagaatacaaaccagagaagcttccttcacattcctttgagattgaccatgaagatgctgataaggatgaagataccacttcccactcgtcttccaaggggggtggaggagcgggaggaactggtgttttcaagtccggctggctctacaaggggaattttaacagcaccgtgaacaacaccgttactgttcggtcattcaaaaagcgctacttccagctgactcagttaccagataactcctacattatgaacttttacaaagatgagaaaatatccaaagaacccaaaggatgcatctttttggattcctgtacaggagtggtgcagaataacagactaagaaaatatgcctttgaattgaaaatgaatgatctgacctattttgtgctggcagctgaaacagagtcagatatggatgaatggatccacaccctcaaccgcattctgcaaatcagtcctgaggggcccctccaagggaggaggagcacagagctcactgatctgggtctggattcgctggataattctgtaacttgtgaatgcacgccagaggaaacagattcttcagagaacaacctacacgcagactttgcaaagtacctcacagaaacagaagatactgtaaaaacaactcgaaacatggagaggctaaatctgttctctctagatccagacatagataccttgaaacttcaaaaaaaagatctcttggaacctgagtctgtgatcaaaccatttgaagaaaaagctgccaagagaatcatgatcatctgtaaagccctcaactcaaatcttcagggatgtgttacggagaatgaaaatgatccgataacgaatattgagcctttttttgtgagtgtggcactttatgacctcagagacagcaggaagatttctgctgattttcatgtggatctaaaccatgctgctgtcagacagatgctcttgggggcttctgtggctttggaaaatggcaacatcgacaccatcactccaagacaatcagaagaacctcacatcaagggacttccagaggaatggctaaaatttccaaagcaggctgtattttctgtaagcaatccacattctgaaattgttttggtggccaaaatcgaaaaagtcttgatgggaaacattgcaagtggtgccgaaccttatattaagaacccagactccaacaagtatgcacaaaagatactaaaatccaacagacaattctgcagcaaattgggaaaataccgtatgccttttgcttgggcagtaagatcagtatttaaggacaaccagggaaatgtggacagagactcaagattttcaccattgtttagacaagaaagtagcaagatttcaactgaggacctagttaaactagtatcagattatagaagggccgacagaataagcaaaatgcagaccattcctggaagcctggatattgctgttgacaacgttcccttggagcatccaaattgtgtaacatcgtcctttatccctgtcaagcctttcaacatgatggctcaaacagaacccacagtggaggtggaagaatttgtttacgattcaacaaagtattgtcggccttacagagtatataaaaatcaaatttatatttaccccaaacacctcaagtatgatagccagaaatgcttcaacaaggcacggaatataactgtgtgcattgaattcaaaaattcagatgaagaaagtgccaagcccctgaagtgtatttatggaaaacctggagggcccctcttcacctcagccgcctacacagcagttctgcaccactctcagaatccggatttctcagatgaggtgaaaattgagctaccaacacaactccatgagaaacaccatattttgttttctttttatcacgtcacctgtgacatcaatgcaaaagctaatgccaaaaagaaggaggctctggaaacgtcagttggatatgcttggcttcctctgatgaaacacgatcagatagcttctcaagagtacaacatcccaatagcaacaagtctgcctcctaattatttaagctttcaagattctgcaagtggaaagcatggtgggagtgacattaaatgggttgatggtggcaaaccacttttcaaagtgtcgacatttgttgtatcaacagtaaatactcaggatccacatgtgaatgcatttttccaagagtgccaaaaaagagagaaagatatgtctcagtcacctacctcaaatttcatccgctcttgtaagaacttattgaatgtggaaaagattcatgcaatcatgagttttctgcctataattttgaatcagctcttcaaagttctggtacagaatgaggaagatgaaataactacaactgtcaccagggttctgaccgacattgtggccaagtgccatgaggagcagctggatcattctgtccagtcatatattaagttcgtgttcaagaccagggcatgcaaggagaggactgtacatgaggaactggctaaaaatgtgactggtcttttgaaatcaaatgactcaacaacagtaaagcatgtcctaaagcattcctggttcttctttgcaattatcctaaaatcgatggcacagcacttgattgacacaaataaaatccagcttccccggcctcagagatttcctgaatcttaccaaaatgaattggacaatcttgtcatggtcctatccgaccatgtgatttggaaatacaaggatgcacttgaagaaacaagaagggcaaaccacagcgttgccagatttctcaagcgctgctttacatttatggaccgagggtatgtgtttaagatggtcaacaattacatcagcatgttctcctccggtgaccttaagaccttgtgccagtataaatttgattttcttcaagaagtatgtcaacatgaacactttatccctttgtgtctgcccataagatcagcaaacattccagatcctttgacaccttcagaatcgactcaagagttacatgcatcagatatgcctgaatattcagtcacaaatgaattttgtcgcaaacacttcttaatcggaattctgctccgagaagttggctttgccctgcaggaagaccaagatgtcagacacttagctttagctgtcctaaaaaatctaatggctaagcattcatttgatgatcgatacagagagccaagaaagcaggcccagatagcaagtttatacatgcccctgtacggcatgctcctggacaatatgccaaggatttatctgaaggacctgtatccttttactgtcaatacatctaatcaggggtctagagatgatctaagcaccaatggaggatttcaaagccagacagctatcaaacatgcaaactctgtggatacatcattttctaaagatgttttaaattccatagcagcattttcatcaatagctatttctacagtaaaccatgctgactccagagcatctttagcaagtcttgactccaatccaagtaccaatgagaagagcagtgagaagacggacaactgtgaaaagatcccaagacccttgtctttgattggctcaactcttcgatttgacaagttagatcaagcagaaaccaggagtctcctgatgtgttttcttcacattatgaaaacgatttcgtacgagactctgattgcctactggcagagagctcccagcccagaggtgtccgacttcttcagcatcttggacgtttgtcttcaaaatttcagatacctaggaaaacgcaacataataagaaaaattgctgctgcatttaaatttgtgcagtccacccagaacaatggaactctcaaaggatccaatccttcctgccagacatcaggtctcttgtcacaatggatgcactccacttccagtcatgaaggccataagcagcacagatcacaaactttacctataattcgaggcaaaaatgcactttctaaccccaaactcttacagatgttagacaataccatgaccagcaactccaatgaaatagacatcgtgcatcatgtagacactgaggccaatatagctacggaggtttgcctcactattctggacctgttatccctcttcacacagactcatcagagacaactccaacaatgtgactgtcaaaattcattgatgaaaagggtctttgatacctacatgctctttttccaagtcaatcagtcagccacagcgctgaagcatgtgtttgcctccttgagactgtttgtatgcaagtttccttcagcgttctttcaagggcctgctgacctctgtggatcattctgttacgaagtcctaaaatgctgtaaccacaggtcacggtcaactcagacagaagcctcagcccttctgtactttttcatgaggaagaattttgaatttaacaagcagaagtcaattgtccggtcccacttacaactcatcaaagctgtgagccagttaatagccgatgctgggattggaggctctcggtttcaacattcgcttgcaattaccaataatttcgccaatggagataagcaaatgaaaaacagcaatttcccagcagaggtgaaggacctgactaagcgtataaggactgttttgatggccacagctcagatgaaggagcacgagaaggaccccgagatgctggtggatctccagtacagcctggcaaactcctacgcaagcactcctgaactacgcaggacctggctggaaagtatggccaagattcatgccagaaacggagatttatctgaggctgccatgtgttacatccatattgctgctctcattgcagagtatctgaaaagaaagggttactggaaagtggaaaagatttgcacagcatccctgctctcggaggatacccacccctgtgatagcaactcattactaacaactcccagtggaggaagcatgttctctatgggatggccagcttttttgagcattacaccaaacattaaggaagaaggagcgatgaaagaggattctggaatgcaagatacaccatacaatgagaatatcctggtggagcagctatacatgtgtgtggagtttctctggaagtctgagcgatatgaactcattgctgatgtcaacaagcccatcattgctgtctttgagaaacaacgagacttcaaaaaattgtcagatctctactacgacattcatcggtcatatctgaaagtggcagaggtggtgaattcggagaagcggctgtttggtcgctactatcgtgtggcattttatgggcagggcttttttgaagaagaagaaggtaaagagtatatttataaagagcctaagctgacaggtctgtccgagatttcccaaagattactcaagctctatgcagataaatttggagcagacaatgtgaagataatccaggattccaacaaggtaaaccccaaggatttggaccccaaatatgcctacatccaggtgacctatgtgacgccgttctttgaggaaaaggaaatcgaagaccggaagacagatttcgaaatgcaccacaacatcaaccgctttgtcttcgagacacccttcacgctgtcgggcaagaagcacggtggggtggcggagcagtgcaagcggcggacgatcctgacaacgagtcacctgttcccctacgtgaagaagagaatacaagtaattagccaatcgagcacagaactgaatccaattgaagtggcaattgacgagatgtccaagaaggtttctgagcttaatcagctttgcacaatggaagaagtggacatgatcagactgcagctcaaactgcaaggaagtgtcagcgtgaaggttaatgctgggccaatggcctatgcacgagcttttcttgaagaaaccaatgcaaagaagtaccctgacaaccaagtaaagcttttgaaggagatcttcaggcaatttgcagatgcatgtgggcaggcccttgacgtgaatgagcgcctcatcaaagaggaccagctggagtaccaggaagaactgaggtcccactacaaggacatgctcagcgaactctccacagtcatgaatgagcagattacgggcagggacgacctgtcaaagcgcggagtggaccaaacctgcactcgagtaattagcaaagcaactccggccctacccacggtctccatctcatctagtgctgaagtctgagggctctgcagcatcagacccacctctaagagaactttctgaatttgcagctaatctcggggaagagaaagataggtttaatttatttgaagttttcatggtgttaatatttttgtttacctcgctagcttcagaattttgccaacctctgaatttgcacattttgtataatttttttttctttgagcagtgttgatcaagccaggttgaatatttgccatgaaattccagtgaatgtgtagctcaaatgcaaaccctaagtttgctgtcagttattgtatggtcagtaccccagtcctagtacacatattttaaaggttaaagtgaatgtttttgtaacatttaagcatatttcagatgtaaataaaagattgtaaaatatacggtttttaccaaatttaaaagatcctttttagttaatactatgacagtactaaaaatatatgaataacatttcagataccattatattaaaatatttgtgtatgtgtacaaaagcgttgataaatactaatctttaaagtttgtggagttcctttatttgtaatatatgtgctcttaaaagcaatgggatgtgaaattatgaaagtattttattgttcatagaaataaaaaacacagttactttgca

SEQ ID NO: 125815 - DNA, 592 bp, Homo sapiens
  Payload ID: 4649
  Gene Symbol: DOCK10
  Gene Name: dedicator of cytokinesis 10
  ENST ID: ENST00000435582
  CDS Start-End: 72-500
gagaaggttggcgcggggaagaccggcgggaggcgcgccccgggcccgcggcgcgattggcgtgaccggcgatggccggtgagcggacccgcaggttcacccggagcctgttgagacctgggcaggcggccgagctccggcacagcgccgcgtccgccgccgcggtggcagtcagcagccggcagcagcagcggcaagaaaagcctaggcttctcgagcctttggattatgagactgtcattgaagaacttgaaaagacctaccggaatgatcctcttcaagatctcttgttcttccccagtgatgacttttcagcagccacagtttcctgggatatccgcacgttgtactcaacagtacctgaagatgcagagcacaaggcagaaaatttactggttaaggaggcttgtaaattttatagttcccagtggcatgtggtaaactacaaatatgaacaatattctggagacattcgacagctaccccgcgagggtccataggaagatactgaagaaatagatgacttcaggctagaatggaaaatgtaagcctttacacactaggaatagaaatcagcactaacttggagatc

SEQ ID NO: 125816 - DNA, 1140 bp, Homo sapiens
  Payload ID: 4649
  Gene Symbol: DOCK10
  Gene Name: dedicator of cytokinesis 10
  ENST ID: ENST00000422684
  CDS Start-End: 1-1140
ctttgtgtctgcccataagatcagcaaacattccagatcctttgacaccttcagaatcgactcaagagttacatgcatcagatatgcctgaatattcagtcacaaatgaattttgtcgcaaacacttcttaatcggaattctgctccgagaagttggctttgccctgcaggaagaccaagatgtcagacacttagctttagctgtcctaaaaaatctaatggctaagcattcatttgatgatcgatacagagagccaagaaagcaggcccagatagcaagtttatacatgcccctgtacggcatgctcctggacaatatgccaaggatttatctgaaggacctgtatccttttactgtcaatacatctaatcaggggtctagagatgatctaagcaccaatggaggatttcaaagccagacagctatcaaacatgcaaactctgtggatacatcattttctaaagatgttttaaattccatagcagtaaaccatgctgactccagagcatctttagcaagtcttgactccaatccaagtaccaatgagaagagcagtgagaagacggacaactgtgaaaagatcccaagacccttgtctttgattggctcaactcttcgatttgacaagttagatcaagcagaaaccaggagtctcctgatgtgttttcttcacattatgaaaacgatttcgtacgagactctgattgcctactggcagagagctcccagcccagaggtgtccgacttcttcagcatcttggacgtttgtcttcaaaatttcagatacctaggaaaacgcaacataataagaaaaattgctgctgcatttaaatttgtgcagtccacccagaacaatggaactctcaaaggatccaatccttcctgccagacatcaggtctcttgtcacaatggatgcactccacttccagtcatgaaggccataagcagcacagatcacaaactttacctataattcgaggcaaaaatgcactttctaaccccaaactcttacagatgttagacaataccatgaccagcaactccaatgaaatagacatcgtgcatcatgtagacactgaggccaatatagctacggaggtttgcctcactattctggacctgttatccctcttcacac

SEQ ID NO: 125817 - DNA, 528 bp, Homo sapiens
  Payload ID: 4649
  Gene Symbol: DOCK10
  Gene Name: dedicator of cytokinesis 10
  ENST ID: ENST00000458608
  CDS Start-End: 11-139
gtgaccggcgatggccggtgagcggacccgcaggttcacccggagcctgttgagacctgggcaggcggccgagctccggcacagcgccgcgtccgccgccgcggtggcagtcagcagccggcagcagcagcggcactaaaatatgtttgctcaaaacagagggagatgaaaaactactggcagccagtacttcttaaaagaaaaagaagcatgttttacttctctggggtgaacataccaattaaaacgatgctgtgttgtgacagattactgagcaattaatgcctgtttgagcatcatgctagatgcttccgcgaaagcaacctcactgaggctggggcggccacacgttacagcaaaacaatccttcctcaaacttcctgcagcacccttcacgccgaggagcccagaaaccacagaaaacatttttttttctttgaatctccaagagttacactggaagaattagcttggcagaaagatctcaagattgaattctattggggatttcatactttcctcatttgt

SEQ ID NO: 125818 - DNA, 568 bp, Homo sapiens
  Payload ID: 4649
  Gene Symbol: DOCK10
  Gene Name: dedicator of cytokinesis 10
  ENST ID: ENST00000535663
  CDS Start-End: 1-568
ctacgacattcatcggtcatatctgaaagtggcagaggtggtgaattcggagaagcggctgtttggtcgctactatcgtgtggcattttatgggcaggctgtgggcttttttgaagaagaagaaggtaaagagtatatttataaagagcctaagctgacaggtctgtccgagatttcccaaagattactcaagctctatgcagataaatttggagcagacaatgtgaagataatccaggattccaacaaggtaaaccccaaggatttggaccccaaatatgcctacatccaggtgacctatgtgacgccgttctttgaggaaaaggaaatcgaagaccggaagacagatttcgaaatgcaccacaacatcaaccgctttgtcttcgagacacccttcacgctgtcgggcaagaagcacggtggggtggcggagcagtgcaagcggcggacgatcctgacaacgagtcacctgttcccctacgtgaagaagagaatacaagtaattagccaatcgagcacagaactgaatccaattgaagtggcaattgacgagatgtccaagaaggtt

SEQ ID NO: 125819 - DNA, 6625 bp, Homo sapiens
  Payload ID: 4650
  Gene Symbol: DOCK11
  Gene Name: dedicator of cytokinesis 11
  Uniprot ID: Q5JSL3
  ENST ID: ENST00000276202
  CDS Start-End: 64-6285
gcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttacagcgaccccctccgagatctgcttatgttcccaatggaagatatatctatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaaattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatgcagaatcaagaaggcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaa

SEQ ID NO: 125820 - DNA, 6664 bp, Homo sapiens
  Payload ID: 4650
  Gene Symbol: DOCK11
  Gene Name: dedicator of cytokinesis 11
  ENST ID: ENST00000276204
  CDS Start-End: 75-6308
cgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttacagcgaccccctccgagatctgcttatgttcccaatggaagatatatctatctcggtgataggtcgtcaacgcagaacggtgcagtctactgtaccagaagatgctgaaaagagggcccagagtttatttgttaaagagtgtattaaaacctatagcacagattggcacgtggtaaactacaagtatgaggacttctctggggactttcgaatgttgccatgtaaatctttgagaccagaaaagattcctaatcatgtatttgagatagatgaagactgtgagaaagatgaggactcatcttctttatgttctcagaagggtggtgtgataaaacaaggctggttgcataaagcaaatgtaaatagtaccatcacagtaaccatgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaaattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatgcagaatcaagaaggcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcaggcaagtattaggatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaattagaagtgaaagaaa

SEQ ID NO: 125821 - DNA, 6041 bp, Homo sapiens
  Payload ID: 4650
  Gene Symbol: DOCK11
  Gene Name: dedicator of cytokinesis 11
  ENST ID: ENST00000633080
  CDS Start-End: 1-5709
atgaaggtattcaagagacgatatttttacttgacccaacttcctgacggttcatatattctcaattcctataaagatgagaaaaattcaaaagaatcgaaaggttgcatctacttggacgcctgcattgatgttgttcagtgccccaaaatgcgccgtcatgcttttgaactcaagatgttagataaatatagccattatctggctgctgaaactgagcaggaaatggaggaatggttgataactttgaaaaagattattcagatcaacaccgacagtttagttcaagaaaaaaaggagacggtagaaacagcacaagatgatgaaactagcagccaaggaaaagccgagaacatcatggcaagtttggaaaggagcatgcatccggaactgatgaagtatggaagagaaactgaacaactaaacaaactcagtagaggagatggaagacagaatctcttttcttttgattcagaagttcagaggttggacttttcaggaattgaacctgatataaagccatttgaagaaaaatgcaataaacgtttcctggtgaattgccatgatttaactttcaatatcttgggccaaattggagacaatgcaaaaggaccacccacaaatgttgagcccttttttatcaatcttgccttatttgatgtaaagaacaattgtaagatttcagcagactttcatgtagacctgaatcccccatctgtccgtgaaatgctgtggggctcttcaacccaactggccagtgacggtagcccaaagggctcttcacccgaatcttacattcatggaattgccgaatctcagttacgctacatacaacagggaattttctcagtgacgaatccacatcctgaaatttttctagttgccagaattgaaaaggtactacagggaaacattacacactgtgcagaaccctatatcaaaaattctgatccagtaaagacggcccagaaggtgcacaggacagctaaacaagtgtgtagccgccttggacaatacagaatgcccttcgcttgggctgccagacccattttcaaagatactcaaggctctcttgatctggatgggagattttctcctctgtataaacaagacagtagcaagctttcaagtgaagacattctcaagttgctctcagaatataagaagccagaaaagaccaaactgcagattattcctgggcagctaaacatcacagtagaatgtgttcctgtggatttatcaaattgtattacttcttcatatgtgcccttgaagccttttgaaaagaattgccaaaatattactgtggaggttgaagagtttgttccagaaatgacaaaatattgttatccatttactatttacaaaaaccatctgtatgtatatcccctgcaattaaaatacgatagccagaaaacatttgccaaggcaaggaacattgcagtctgtgtggaattccgggattcagatgaaagtgacgctagtgccctaaagtgtatttatggaaaacctgcagggtctgtttttaccacaaatgcttatgctgttgtctcgcatcacaaccaaaatccagagttctatgatgagattaaaattgagcttcccattcacctacatcaaaaacatcatttgcttttcactttttatcatgtaagttgtgaaattaacacaaagggaacaaccaaaaagcaagacacagttgaaactccagttgggtttgcctgggtacctttgctgaaagatggtagaatcatcacatttgagcagcagctgccagtttccgccaatcttcccccaggctacttgaatctgaatgatgcagaatcaagaaggcaatgtaacgtggatattaaatgggtagatggtgcaaagcctttgttgaagattaaaagccacttagaatctaccatttacactcaagatctgcatgtgcacaaattcttccatcattgccagctgattcagtcaggctcgaaagaagttccaggggagctcattaaatatttaaagtgtttgcatgccatggagatccaagtcatgatacagtttctacctgtaattcttatgcaactcttccgagttctcacaaatatgacccatgaagatgacgttcctatcaactgcaccatggttctcttacatattgtatcaaagtgccatgaagaaggcttggatagttatctaagatcattcataaagtatagcttccgacctgaaaaaccgagtgctcctcaggcccagctgatacatgaaaccctggctactacgatgatagcaatattgaaacagtctgcagattttttatcaataaacaaattgctaaagtactcatggtttttctttgaaataattgcaaagtcaatggccacatacttgttggaagagaataagattaagcttccccgaggccagagatttcccgagacatatcatcatgtcttacattcactgcttcttgcaataattccccatgtgactattcggtatgcggagattcccgatgagtccagaaatgtgaactatagtttggctagcttcctgaagcgctgtttgacactaatggatagaggatttattttcaatttaataaatgactatatatctggattcagccccaaagatcctaaggttctggctgaatacaagtttgaatttctgcaaacaatttgcaatcacgaacattacattcctctgaacttgccaatggcatttgcaaaacctaaactgcagcgggttcaagattttttttcatttgcggtggaccgtttgacttcagtagattcaaatcttgaatacagtttatcagatgagtattgcaagcatcacttcttggttggtctacttctgagggaaacttccattgctcttcaggacaattatgagatcagatatacagctatctctgttataaagaatcttttgataaaacatgcatttgacacaagataccagcacaagaaccaacaagccaaaatagcacaattgtacctcccctttgttggactacttttggaaaatatacagcgattagcaggtcgagataccttgtattcttgtgcagccatgcctaattctgcatccagagatgagtttccatgtggctttacttcacctgccaatagagggagtctgagcactgacaaagacaccgcttatgggtcttttcaaaatggacatggaattaagagagaagattcaagaggttccctcatcccagaaggagcaacaggatttccagatcagggcaacactggtgaaaatacccgacagagttctacaaggagtagtgtatcccagtataaccgcctggatcagtatgaaatcagaagcctcctgatgtgctacctgtatatagtaaaaatgatttcagaagatactctcttaacttactggaataaagtatcacctcaggagctcataaacattcttatacttttagaagtatgcttgtttcactttagatatatggggaaaagaaacatagcaagggtgcatgatgcctggctgtcaaaacacttcggaatagaccgaaaatcgcaaaccatgcctgctcttcgaaacagatcaggagtaatgcaggcccggcttcagcatcttagtagcctagaaagttcatttacacttaatcacagttctacaacaactgaagcagacattttccaccaggcacttcttgaaggcaatacagctactgaagtttccctaacagtactagacaccatatcatttttcactcagtgcttcaagacccaacttttaaataatgatggccataacccattaatgaaaaaagtgtttgatatacatcttgcttttcttaaaaatggacaatctgaagtgtcgctgaaacatgtatttgcctcactgagagctttcatcagtaagtttccttcagcatttttcaaaggaagagtaaacatgtgtgctgcattttgctatgaggttttaaagtgctgcacatcgaagattagctcaaccaggaatgaagcatctgcacttttgtatcttttgatgagaaacaactttgagtataccaaaaggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgaccaagagaatccgcactgttcttatggccactgcccaaatgaaggagcatgagaaagaccctgaaatgctaattgatctccagtatagcttagccaagtcctatgcaagcaccccagagctcaggaaaacctggcttgatagcatggccaagattcatgtaaaaaatggagatttttcagaggctgcgatgtgttatgtccatgtagcagctctagttgcagagtttcttcatcgaaaaaaattatttcctaacggatgttcagcgttcaagaaaattactcccaatatagatgaagaaggagcaatgaaagaagatgctgggatgatggatgtccattatagtgaagaggtcttgctggagttgctagaacaatgtgtggatggcttatggaaggcagaacgttatgaaataatttctgagatttccaagttgatcgttccaatttatgagaaacgtcgtgagtttgagaaacttactcaagtttatagaactcttcatggagcttacacaaaaattctggaagttatgcatacaaaaaagagacttttaggcactttcttcagagttgccttttatggccaatctttttttgaagaagaagatggaaaggagtacatctataaagaaccaaagctcactggcctctcagaaatttccttgagacttgttaaactttatggtgaaaagtttggtacggagaatgtcaaaataattcaggattcagacaaggtaaatgccaaagagcttgatccaaaatatgctcatatacaagttacttatgtgaagccttactttgatgacaaagaactcacagaaaggaagaccgagtttgaaagaaatcataatatcagcagatttgtttttgaggccccttacactttatcaggcaaaaaacagggctgtatagaagaacagtgcaaacgccgtacaatcttgacaacttcaaactcgtttccttacgtgaagaagaggattcctattaactgtgaacagcagattaatttaaaaccaattgatgttgccactgatgaaataaaagataaaactgcagagctgcaaaagctttgctcctctactgacgtggacatgattcagctccaacttaaattgcagggctgtgtttctgtgcaggtcaatgctggtccattagcatatgcaagagctttcttaaatgacagccaagctagcaagtatccacctaagaaagtgagtgagttgaaagacatgtttaggaaatttatacaagcatgcagcattgcacttgaactaaatgagcggctaattaaagaagatcaagttgagtaccatgaagggctaaagtcaaatttcagagacatggtaaaagaattatctgacattatccatgagcagatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaactt

SEQ ID NO: 125822 - DNA, 593 bp, Homo sapiens
  Payload ID: 4650
  Gene Symbol: DOCK11
  Gene Name: dedicator of cytokinesis 11
  ENST ID: ENST00000632573
  CDS Start-End: 1-121
tgcacttgaactaaatgagcggctaattaaagaagatcaagttgagtaccatgaagggctaaagtcaaatttcagagacatggtaaaagaattatctgacattatccatgagcagctttgaagacttaagtcgatattacaagaagacacaatgcattctccctggatgagcaacacattacatgtattttgtgcaattagtggtacatcaagtgaccgaggttatggttccccaagatacgctgaagtgtgaggaaatgcagatgtacgtgacaatgagactgacctttctcaggaatatttggagctgtgcaaatgttaaaatttaaagatttgatatacatggagtgtttcttctcgacaccaaaattttcatgtgttccaacagggtgcttacatatttgtaaataagcaacttgaaagtgcctggaaaattgcaccactgtgcttggtttgtacttttttaggtaaatctatatgctgaaaagtagagctcaaaaacagtagttcaatttgcttaattattgcttaaaataatggtactatgtaaaattgtataatggaatacaataaaaggtaaaacttatttgtaa

SEQ ID NO: 125823 - DNA, 6097 bp, Homo sapiens
  Payload ID: 4651
  Gene Symbol: DOCK2
  Gene Name: dedicator of cytokinesis 2
  Uniprot ID: Q92608
  ENST ID: ENST00000256935
  CDS Start-End: 81-5573
aggaaggaagtggggccctgcggcgcccagccaccccctgacggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaggagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctcctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcaccgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctgaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgtcccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagcttgaatgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgtttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcgaataa

SEQ ID NO: 125824 - DNA, 446 bp, Homo sapiens
  Payload ID: 4651
  Gene Symbol: DOCK2
  Gene Name: dedicator of cytokinesis 2
  ENST ID: ENST00000433448
  CDS Start-End: 1-168
ctgtggaacaactattttcatctggcagtggcttttatcacccaggattctctgcagctggagcagttctcacacgccaaatacaacaaaatcctgaataagtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctcctggagtcaatcctgatggaatgtgctgcagagcacccaaccattgccaagtcggtggagaacttcgtgaacctggtcaaaggcctcctggagaagctgctggattaccggggtgtgatga

SEQ ID NO: 125825 - DNA, 631 bp, Homo sapiens
  Payload ID: 4651
  Gene Symbol: DOCK2
  Gene Name: dedicator of cytokinesis 2
  ENST ID: ENST00000519628
  CDS Start-End: 1-486
aaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaggagatcatggtccagctgctgcggacagtgaaccggacagtcatcaccatgggccgggatcacattctgattgatgcagctgatgataggactgaaccgattgggtgctacggagtattaaatgtgatagtatctgccaagggttagcacagggctgctcacgggatcagtgctcagtaaatgctagttatcatgcaatccttattgttagtttcattattatctgtatgataaattgattgtagtgtcatctgcaaataggtaaataaagcattatacattgccaaaacaa

SEQ ID NO: 125826 - DNA, 5656 bp, Homo sapiens
  Payload ID: 4651
  Gene Symbol: DOCK2
  Gene Name: dedicator of cytokinesis 2
  ENST ID: ENST00000524185
  CDS Start-End: 37-3132
cttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaggagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagggtttttccagaactggaatgtgacgaagggcttgctggaagaatccacttctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctcctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcaccgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctgaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgtcccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatc

SEQ ID NO: 125827 - DNA, 4654 bp, Homo sapiens
  Payload ID: 4651
  Gene Symbol: DOCK2
  Gene Name: dedicator of cytokinesis 2
  ENST ID: ENST00000520908
  CDS Start-End: 165-4133
aaaagacacagttaacaggcaagcagccatcttatctcctgtctgagccactctttcttccacttttgtcaccctttcaagtcactaccgagcaggctgagcagatgcacttatccaagatgagtagaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaggagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctcctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcaccgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctgaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgtcccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagcttgaatgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgtttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcgaa

SEQ ID NO: 125828 - DNA, 1753 bp, Homo sapiens
  Payload ID: 4651
  Gene Symbol: DOCK2
  Gene Name: dedicator of cytokinesis 2
  ENST ID: ENST00000540750
  CDS Start-End: 164-1171
tacttctccagcctccctgatgagggaaaaatgctttctctaagcaattctgattttaattaataccaatccaggggatgtcaggaacgacatctacattactctcttacaaggtgactttgacaagtacaacaagaccacacagaggaatgtggaagtcatcatgtgtgtgtgcgcggaggatggcaaaacgctgcctgtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactggaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaggagatcatggtccagctgctgcggacagtgaaccggacagtcatcaccatgggccgggatcacattctgattggagcttgctgcaactgcggattcccatcctccaccccacactctctgattcagtggctttggggctgaaacccagcaacaagtttccatagacacccaggaggttccgatgcagatggtccacgaccacgctttgggagcactgtctagggcctacatcttcaatgtaaaccctcacgatgcccttggctgagtggaactcagtgacaatcgaacattccactgagacctaatatccttcagatgagtctggcatctggaaggcagcatgctgtggaatctggcttgttggaagacagaactgtgttctgctgtggccgttgcaattactatttccagaataattgtgcaagtgcctcgcctctctcagcttcaattgcctaatctgaatgttgagcaagtgcctgacccttcctgagcaacagttccttcatctgtaacatgggggtactttaatcaatctcatcattgtgaggattaagtgtgaaaacaaaaggtacttcaagtgatcagtaaataatggatcctcggtaagtggtagctctcttctttctttcccttaagtttcagcccaacagatctctttcgtcagctgttatcattgtaaaaatcatcagttaaaggcaaataaactggcctccaattatgagg

SEQ ID NO: 125829 - DNA, 8755 bp, Homo sapiens
  Payload ID: 4652
  Gene Symbol: DOCK3
  Gene Name: dedicator of cytokinesis 3
  Uniprot ID: Q8IZD9
  ENST ID: ENST00000266037
  CDS Start-End: 24-6116
gcggggccgcgcccggcacggccatgtggacccccacggaggaggagaaatacggcgtagtgatatgcagctttcgaggatctgtccctcaagggttggtcttagaaataggagaaacagtccagattcttgaaaaatgtgaaggttggtacagaggagtttcaacaaagaagccaaatgtgaaggggatctttcctgcaaattacattcacttgaaaaaggcaattgtcagtaatagggggcagtatgaaactgtggttccacttgaagattctattgtgactgaggttacagcaactctacaagaatgggcaagtttgtggaaacagttgtatgtgaaacacaaagtagatcttttctacaaactacgccatgtgatgaatgaacttattgacctgcgaaggcagctactgtctggtcacctgactcaggatcaggtgcgggaggttaagcggcacatcaccgtgcgcctggactggggtaatgaacatttgggcctggacctggtgcctcggaaggactttgaagtagtggactcggaccagattagtgtctcagatctctataagatgcatttatctagccggcagagtgtacagcaaagcacatcccaggtagatacaatgcgcccacgtcatggggaaacatgtcggatgccagtgccacatcacttcttcctcagcctgaagagtttcacttacaatactattggggaagataccgatgtcttcttttccttatatgacatgagggaaggcaagcagatcagtgagcggtttctggtaagactgaacaagaatggtgggccgaggaacccagagaagatagaacgaatgtgtgccctttttacagatctgagcagcaaagatatgaagagagatttgtatatcgttgcccatgtgatccgaataggccggatgctcctgaacgactcaaagaaaggtcctcctcacctgcactacaggcgaccatatggctgtgcggtcctaagcatcttggatgtcctacagtcactcacagaagtaaaggaagaaaaggattttgttcttaaggtttacacgtgcaacaacgagagtgagtggtcccagatccacgagaacatcatccgaaagtccagtgccaagtactctgcccccagcgccagccatggtcttatcatttctctgcagcttcttcgtggagacatggaacagattcggagagaaaatcccatgatatttaataggggattggcaattacaagaaaattgggatttcctgatgtcattatgccaggtgatatccgcaatgacctgtacctaaccctggagaagggggatttcgagagaggaggaaagagtgtacaaaagaatattgaagtgaccatgtatgtgctttatgcagatggagaaatcttgaaggattgcatcagcttgggttcaggagagccaaataggagttcctaccactcctttgtcctctaccacagtaatagtcctcgctggggagaaattatcaaattgcctatccccattgaccggttccggggctcccacctgcgctttgagttcagacattgttccacaaaggacaaaggggaaaagaaactctttggctttgcattctcaaccctgatgcgtgatgatggcaccaccctctcagatgatattcacgagctttatgtgtacaagtgtgatgagaatagcacgtttaataaccatgctctgtacctgggcctgccctgctgcaaagaggactacaatggctgccctaatattccttctagcctcatcttccagcgcagcaccaaagagtctttcttcatctccactcagctctcctctaccaaactcacccagaatgtggacctcctagctctgctgaagtggaaagccttccccgaccggatcatggatgtactagggcggctgcggcatgtcagtggggaggaaattgttaagtttctgcaggacatcttagatacactctttgtgattttggatgataatacagagaagtacggcctgttggtttttcagtctctggtgttcatcatcaacctgctccgagacatcaagtattttcactttcgacctgtgatggacacgtatatccagaagcactttgctggagctctggcatacaaggagctcatccgctgtttgaagtggtatatggactgctcagcagaactgattcgacaggaccacattcaagaagctatgcgggccttggagtaccttttcaagttcattgtacagtcacggatcctgtactcacgagccacttgtggaatggaagaggaacaattcagatccagtatccaagaacttttccagtccatccggtttgtgctcagtctggacagccgaaactcagaaacactcctttttactcaggctgcactcctcaattctttcccaaccatctttgatgagcttctgcaaatgttcaccgtgcaagaggtggcagagtttgtgagagggacactggggagcatgcccagcactgtgcacattgggcagtcaatggacgtggtcaagctgcagtccattgccaggacagtggatagccgcctgttttctttctcagaatcccgccgcatcctgcttcctgtggttctccatcacattcaccttcacctgaggcagcagaaagagctgctaatttgctcagggattcttggcagcatcttctccatcgtcaagaccagctctctggaggcagatgtcatggaggaagtagagatgatggtggagagcctcctggacgtgctcttgcagactctgctcaccatcatgagcaaatcgcacgctcaggaggcggtaagagggcagcggtgcccgcagtgcacagccgagatcactggcgagtatgtgtcctgccttctctcactgctccgccagatgtgtgacacccatttccagcacctcctggacaacttccagagcaaagatgaactcaaggaatttctgctgaagattttttgcgtgttccggaacctgatgaagatgagtgtcttccctcgggactggatggtaatgagactgctcacaagcaatattatagtcactactgtccagtacctgtcctctgcactgcacaagaatttcacagagactgactttgactttaaggtgtggaattcttactttagcctggcagttctattcataaatcagccaagccttcagctagaaattatcacctcagccaaaaggaagaagattctagataagtatggggacatgcgtgtaatgatggcctatgaactgttcagcatgtggcagaatttgggtgaacataagatccactttattccgggaatgattggtccttttctgggtgtgacactggtcccacagccagaagtacggaatatcatgattcccatctttcatgacatgatggactgggagcagagaaaaaatggcaacttcaaacaggtggaggccgagttgattgacaagctggacagcatggtgtcagaagggaaaggtgacgagagctacagggagctcttcagcctactaacccagctgtttgggccctaccccagcctgctggagaaggttgaacaagaaacatggcgcgagaccggcatttcctttgtgacctcagtcacccgcctcatggaacgtcttcttgactacagggactgcatgaaaggagaggaaacagagaataagaagataggctgcactgttaacctgatgaatttttacaaatctgagattaacaaggaagaaatgtatatccgctacatccataagctttgtgacatgcacttgcaggccgaaaactacacagaggccgcatttaccctgctcctttactgtgagctgctgcagtgggaggaccggccactacgggaattcctccactacccatcgcagacagagtggcagcggaaggagggactgtgccggaagatcattcactacttcaacaaaggcaagagctgggagtttgggatcccactgtgcagggagctggcgtgtcagtacgagagcctctatgattaccagagcctcagctggattcggaaaatggaggccagctactatgacaacattatggagcagcaacgcctggagcctgagttctttcgggtcggcttctatggcaggaagtttcctttctttcttcggaacaaagaatacgtgtgccgtggccatgactacgagaggctggaggccttccagcagaggatgctcagtgagtttccgcaggctgtcgccatgcagcaccccaaccatcctgatgacgccatcctacagtgcgatgcccagtacttgcagatctatgcagtgacgcccattccagattatgtggatgttctgcagatggatagggtaccagatcgagtcaagagcttctatcgcgtcaacaatgtgaggaagttccggtatgacaggccttttcacaaaggccccaaggacaaggagaatgaattcaagagcctgtggattgaacgtaccacactgaccctgacccacagcttgcctggcatctctcggtggtttgaagtggagaggagggaactggtggaggtgagccctctggagaatgccatccaagtggttgagaataagaaccaggagctacgctccctgatcagccagtatcaacacaagcaggtgcatggcaacattaacctgctaagcatgtgcctgaatggtgtcattgatgcagctgtcaatggaggcattgcacgctatcaggaggccttctttgataaagattacatcaacaagcacccaggagatgctgagaagatcacccagctcaaggagcttatgcaggagcaggttcatgtccttggagttgggctagcagttcatgagaagtttgtgcacccagaaatgcggcctctgcataagaagctaattgatcagttccagatgatgcgggccagtctctaccatgagtttccaggtttggataagctaagtcctgcatgttcaggcaccagcaccccacggggaaatgttctggcatcccatagccccatgagtccggagagcatcaagatgacccaccggcacagccccatgaacttgatgggcacaggccgccattcatcatcctctctctcctcacatgcgtctagtgaagcaggaaacatggtgatgctgggtgacggctccatgggtgatgctcctgaggacctgtaccaccacatgcagctcgcgtatcccaaccccaggtaccaaggctcagtcaccaacgtctctgttctgtcctcgtcccaggcaagcccttcttcctccagcctgagttccactcactcagcaccatcccagatgattacctctgccccttccagtgcccgaggctctccctctctgccagataagtaccgccatgcccgtgaaatgatgttgttgctgcccacataccgggaccgcccaagcagtgccatgtatccagcagccatcctggagaacggacagccgccgaatttccagcgagccctgttccagcaagtggtcggagcctgcaaaccctgcagtgatcccaatctgtctgtggctgaaaaaggtcattactccctacactttgacgccttccaccaccctctgggtgatacccccccagccctccctgcccggaccctgcgcaagtctcctctccaccctatcccagcctcccccacaagcccccagtcaggtctggacggcagcaactctacgctgtccggcagtgccagcagcggcgtgtcctccttgagtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcccgcattctgtgcttatttaaaacaaggaaacttctaaccatttcttttgtgtattcatgtttaaagaaaaaaagtgatttaaaaatgatcttacctgtaccagaaaagcaaagttaaaggaaacaaaatttgtaccattgtcccaagaggtattttactgtatatattgtggtagcatgttcaaaatccaacaagtaatgtgaattttagatgtaaatatctgccacttgattttttttccccctttccccacttccttgactgctgtgatgtgaattaaagataaatacgtgatactga

SEQ ID NO: 125830 - DNA, 673 bp, Homo sapiens
  Payload ID: 4653
  Gene Symbol: DOCK4
  Gene Name: dedicator of cytokinesis 4
  ENST ID: ENST00000428053
  CDS Start-End: 21-161
attgcagtaaaattgcttggatgaagatgcattccactgagagtctactaaagaaaattgagcgggaaacatggcgggaaagtggcgtttcattaattgctactgtaactcgtctaatggagaggttgttagattacagaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcac

SEQ ID NO: 125831 - DNA, 5999 bp, Homo sapiens
  Payload ID: 4653
  Gene Symbol: DOCK4
  Gene Name: dedicator of cytokinesis 4
  ENST ID: ENST00000445943
  CDS Start-End: 1-5999
ttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactagaacaggctttctgaatagggagtcttcacatggcagtactacattgagcaccttttcagtctgtgcagacacatatggaaaagtgcccatgacaagtagacacactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtataattccactatttggtccctatcctagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactgcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataa

SEQ ID NO: 125832 - DNA, 662 bp, Homo sapiens
  Payload ID: 4653
  Gene Symbol: DOCK4
  Gene Name: dedicator of cytokinesis 4
  ENST ID: ENST00000417165
  CDS Start-End: 269-662
aaactgggctgcaagcatttgtgtttgaatcaacaaatagatagatgtctttggcagcagtaaacgctacccagccaggagtgtgaagtcatgtaactctatctagattagtcccttagaattccaaagggttgcctgctattaaccgtagctgataatgtcactttcacaaaatttaccatggctttttccttggcacaaagaaatacgttttaacttgcctagaaatcctacttgtgaaggggaggaaagagaataatagttgggtatgtttcaggtggaagccaagctaattgacaaactggatagcctgatgtcagaaggcaaaggtgacgaaacataccgcgagctcttcaacagtataattccactatttggtccctatcctagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctct

SEQ ID NO: 125833 - DNA, 6212 bp, Homo sapiens
  Payload ID: 4653
  Gene Symbol: DOCK4
  Gene Name: dedicator of cytokinesis 4
  Uniprot ID: Q8N1I0
  ENST ID: ENST00000437633
  CDS Start-End: 258-6158
cagaacaatgactgcgccgccgggtacccgggagcgcgtcggaggactgtgagcagccgccgccgggagagctgcgggcggcgcagtgtcaacgctgggctcgggagcctccagcgcagatcctgcccagcgcccgcagcccgcgcgaagccgctgggctccggcactgcagcgctgctcggggactgtgcattgttgtgagccggagaaggggcgcggggattacaaagcctgaagaccccggagcccctttagccatgtggatacctacggagcacgagaaatacggcgtggttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtattctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactgcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaag

SEQ ID NO: 125834 - DNA, 600 bp, Homo sapiens
  Payload ID: 4653
  Gene Symbol: DOCK4
  Gene Name: dedicator of cytokinesis 4
  ENST ID: ENST00000437129
  CDS Start-End: 23-600
gcattgcagtaaaattgcttggatgaagatgcattccactgagagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagt

SEQ ID NO: 125835 - DNA, 637 bp, Homo sapiens
  Payload ID: 4653
  Gene Symbol: DOCK4
  Gene Name: dedicator of cytokinesis 4
  ENST ID: ENST00000450156
  CDS Start-End: 74-637
aaaaaacgcaaaacgtcataccagctgtacaaggattttcctgtagcagttgcattgcagtaaaattgcttggatgaagatgcattccactgagagaattccactatttggtccctatcctagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaa

SEQ ID NO: 125836 - DNA, 7997 bp, Homo sapiens
  Payload ID: 4653
  Gene Symbol: DOCK4
  Gene Name: dedicator of cytokinesis 4
  Uniprot ID: Q8N1I0
  ENST ID: ENST00000428084
  CDS Start-End: 274-6201
gcttagttcagtgaatcagaacaatgactgcgccgccgggtacccgggagcgcgtcggaggactgtgagcagccgccgccgggagagctgcgggcggcgcagtgtcaacgctgggctcgggagcctccagcgcagatcctgcccagcgcccgcagcccgcgcgaagccgctgggctccggcactgcagcgctgctcggggactgtgcattgttgtgagccggagaaggggcgcggggattacaaagcctgaagaccccggagcccctttagccatgtggatacctacggagcacgagaaatacggcgtggttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtataattccactatttggtccctatcctagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactgcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaagtatgatgagaagacatttagtgtaggcactttaataacttactcagctccttcgatgaatggaattaaaacttgcttattaaatatcatgttgcacaatattaaaagttgctgatctaaaacgccagatgttaaatgaagtatggctgaatttcattaaaacgtttctcatttggaagtggtaaatagtgataaagactccttttgtacctttttatgttcacttttttttatatagtttaatcttaaaaccaatacgatattgtcaaacgatacaatgtgtgacaatgttgtatcgtttttactgaatacttgatacttggagaaagcttattaagtcagtgcacatcctaacacagtggtccttattttagaagacttctgtaaataaggcaaggtttatcagtgcagatcatcagaattaaagttcaagcaggcgagcaagacagtatacttaaggggttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccaatcagctagattaagcaagaggctccagaagaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaagaaaaaaaaaacttagtgaaaatgtattagcacgattaaatggcaaaaggacttataaaaggcaagggcattaactttcagtcctgcacaaaataaaaaattcctcacgactctccacttttaccagtggagtttgtcttagctgacctgtcgtctttctcttgaaggaggattgctgtagacttctctagcttgaatattgcaacatagcatcttaggtctagatagggatgctaatgccagttgtagaagtgtgaaaaaagcaccttgtatgtagtaatgtattttatatctttgttttttcttttactgactgtttataacactcaattgacaatagatatgaactgtattttaaatcatactgttaaatattttccctcttttgttgggaagctcattttagtttaaccatgtttgttttgttggtagcttacctggaaggcagtgaccacttttttatattctcttaatgaaaccattcagcaggtatatgctgttgaggctggttatagaggttttctataataaatgttcaagtatttttgtatataactggttaattttaataagagataccattatgtgtaaaaaaaagtaaaaataaacgcaaacagttgttgatgcagtatgattgttataattatgccaaatactttacgtatggaaaaagaatatttgtacatatgtgcttttaacaattctgccatattgactttacaattttgaatgtcggaaaaattaatatatgttaaatatttatgtttagtgaaagtgttcataattgagaaaaggaacatatgcattttagctttgtatcttgcaagttttgcagtcagaaattttttgaactagcttttgcttttgataacacttcgtgtttgtaaccaca

SEQ ID NO: 125837 - DNA, 6333 bp, Homo sapiens
  Payload ID: 4653
  Gene Symbol: DOCK4
  Gene Name: dedicator of cytokinesis 4
  ENST ID: ENST00000423057
  CDS Start-End: 1-4169
agggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgattggccccttcctagaagtgaccttgataccccagccagatcttcggaatgtcatgattccaatttttcatgatatgatggactgggagcagaggcggagtggcaactttaaacaggtggaagccaagctaattgacaaactggatagcctgatgtcagaaggcaaaggtgacgaaacataccgcgagctcttcaacagtataattccactatttggtccctatcctagtctactaaagaaaattgagcgggaaacatggcgggaaagtggcgtttcattaattgctactgtaactcgtctaatggagaggttgttagattacagggactgcatgaaaatgggagaggtagatggcaaaaagattggctgcacagttagccttctgaacttctataagactgaactgaacaaggaggagatgtatatacgctacattcacaaactctatgatctgcatctcaaagcacagaactttacagaagctgcatataccctcctcttatatgacgagctactggaatggtctgatcggcccctcagggagttcctgacctaccccatgcaaacagaatggcagcgcaaagagcacctgcacctcaccatcatccagaactttgacagaggcaaatgttgggagaatggcattatcttgtgccggaagattgcagagcagtatgagagttattatgactacagaaacctgagcaagatgcggatgatggaagcctctttgtatgacaaaattatggaccagcaacgtcttgaaccagagttcttcagagttggattttatggaaaaaaatttccatttttcttaagaaataaggagtttgtgtgtcgagggcatgactacgagaggctggaagccttccaacagagaatgctgaacgagttcccccatgccatcgccatgcagcacgccaaccagcccgatgagaccatcttccaggcagaagctcagtatttgcagatatatgctgtgactcccattccagagagccaggaggtcctgcagagagagggtgttccggacaacatcaaaagcttctataaagtgaatcacatctggaaattccgctatgaccgaccatttcacaaaggcacaaaagataaagagaatgaattcaagagtctctgggtggagagaacgtcattatacttggtgcagagtttgcctggcatctctcgctggtttgaagtggaaaagcgtgaagtggtagaaatgagtcctctggaaaatgcaattgaagtgctagaaaataagaatcagcagctgaagactctgattagtcagtgtcagacaagacagatgcagaatattaatcccctgactatgtgcctgaatggagttatagatgctgcagttaatggtggcgtttccaggtatcaagaggcattctttgtcaaagaatatatcttaagtcaccctgaagatggggagaaaattgcacgattaagagagctgatgcttgagcaggcacagattctggaatttggtttggccgtgcatgagaagtttgtacctcaagatatgagaccccttcacaaaaagctggttgaccaattctttgtgatgaagtcgagcttagggatacaggagttctctgcttgtatgcaagccagtcctgtccattttcctaatggaagccctcgtgtgtgtagaaactcagcacctgcttctgtgagcccagatggtaccagggtaattcctagacgcagcccgttaagttacccagctgtcaaccgatattcttcctcctcactgtcctcacaagcttctgctgaagtaagcaatattacagggcaatcagaaagctctgatgaagtctttaacatgcagccaagtccatctacctcaagcttgagttctactcactcggcttcacctaatgtgacaagttctgctccatcgagtgccagagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataagtcacttttctatgtacctgcgatgcattctttgcccgtttacaaaataagaagtatgatgagaagacatttagtgtaggcactttaataacttactcagctccttcgatgaatggaattaaaacttgcttattaaatatcatgttgcacaatattaaaagttgctgatctaaaacgccagatgttaaatgaagtatggctgaatttcattaaaacgtttctcatttggaagtggtaaatagtgataaagactccttttgtacctttttatgttcacttttttttatatagtttaatcttaaaaccaatacgatattgtcaaacgatacaatgtgtgacaatgttgtatcgtttttactgaatacttgatacttggagaaagcttattaagtcagtgcacatcctaacacagtggtccttattttagaagacttctgtaaataaggcaaggtttatcagtgcagatcatcagaattaaagttcaagcaggcgagcaagacagtatacttaaggggttgcaaagcttgggactggaaattgttttgttcttgaaacaaaatacttctttaaggttgcttttgctgtttgactgctgtctacattcgtaaaattctattttgtgaattggtagctaaatcccttactaccctgacaccgtggtatctactgtatttcttttcaaggtgcaatttgcttcagagttccaatcagctagattaagcaagaggctccagaagaaatgtttacttgaattttgcgcttcctttcttgatagtttcctatataaaatttgtcattgaacaagagcaaatgctgaagtattaatgaggcacaaatgactgtgccccattagcaagaattcaggaatcaatacagacagtattaaattaatagcttaagtgaagaaaaaaaaaacttagtgaaaatgtattagcacgattaaatggcaaaaggacttataaaaggcaagggcattaactttcagtcctgcacaaaataaaaaattcctcacgactctccacttttaccagtggagtttgtcttagctgacctgtcgtctttctcttgaaggaggattgctgtagacttctctagcttgaatattgcaacatagcatcttaggtctagatagggatgctaatgccagttgtagaagtgtgaaaaaagcaccttgtatgtagtaatgtattttatatctttgttttttcttttactgactgtttataacactcaattgacaatagatatgaactgtattttaaatcatactgttaaatattttccctcttttgttgggaagctcattttagtttaaccatgtttgttttgttggtagcttacctggaaggcagtgaccacttttttatattctcttaatgaaaccattcagcaggtatatgctgttgaggctggttatagaggttttctataataaatgttcaagtatttttgtatataactggttaattttaataagagataccattatgtgtaaaaaaaagtaaaaataaacgcaaacagttgttgatgcagtatgattgttataattatgccaaatactttacgtatggaaaaagaatatttgtacatatgtgcttttaacaattctgccatattgactttacaattttgaatgtcggaaaaattaatatatgttaaatatttatgtttagtgaaagtgttcataattgagaaaaggaacatatgcattttagctttgtatcttgcaagttttgcagtcagaaattttttgaactagcttttgcttttgataacacttcgtgtttgtaaccacattcatatatatatacatatatatgtgaagctccatatttctgttgctttaaagaagtaaaaccttccatttaaataagatgacatgcataagataacaaagcttccttgatttccttttcctgtgtaatttaatagatttgttgactagtgcttgggcacattataaatcagtgttatttgctcttggagccattttttaaaaaaaattttggcagtgagcagttgaatttatcttgaatttatcatgtgtgtgtatttctgaagcagctacatagcagaacattttaagagattctgttagcccacatgttcatgttggttgctgctgaatggtaaatattaaataaaattaccagattaatcttaa

SEQ ID NO: 125838 - DNA, 4941 bp, Homo sapiens
  Payload ID: 4653
  Gene Symbol: DOCK4
  Gene Name: dedicator of cytokinesis 4
  ENST ID: ENST00000494651
  CDS Start-End: 1-3285
gttattgccagtttccgaggaaccgttccatatggcctgtcattggaaattggagatacagttcagatcctggagaagtgtgatggctggtacagaggatttgccttaaaaaacccaaatatcaagggtatatttccttccagctacgttcacttgaaaaatgcctgtgtaaagaacaaaggacaatttgaaatggttattcccactgaagactctgttatcacagaaatgacatcaacattaagagactggggaaccatgtggaaacaactctatgtgcgtaatgaaggcgatctcttccaccggctgtggcacatcatgaatgaaatcctggacctgaggcggcaggtgctggtgggccacctcacccacgaccggatgaaggacgtgaagcgccacattactgcccggcttgactggggcaatgaacaactgggactggacctggtgcctaggaaagagtacgcaatggtggatccggaagacatcagcattactgagctctaccgattgatggaacatcgacatcggaagaaagacaccccggtgcaggccagcagtcaccacctctttgtccagatgaagagcctcatgtgttccaacctgggagaggagctggaggtcatcttctcactctttgacagtaaagagaaccggccaatcagtgagagatttttcttgaggctgaatagaaacgggcttcccaaagcccctgataaaccggaacgacattgctccctctttgtggatttgggcagcagtgagctaagaaaggacatttatatcaccgtgcacattatccgaatcggtcgaatgggagcaggagaaaaaaagaatgcctgtagtgtccagtaccgacgaccctttggctgtgcagttcttagcatcgctgacctgctaacaggagagacaaaggatgacctcattctgaaagtatacatgtgtaacacagagagtgagtggtaccaaatccatgagaacatcatcaaaaagctgaatgcacgttataacttgactggctccaatgcaggtttagcagtttccttacagctattgcacggagacattgaacaaatcagaagggaatattcatcagtattttctcatggagtatccataacaaggaagctgggattttcaaatattattatgcctggtgaaatgaggaatgatttatatatcactattgaaaggggagaatttgagaaaggagggaagagcgtggccagaaatgtggaagttacgatgttcattgtagacagtagtggccaaaccctgaaggattttatctccttcggctctggggagccaccagccagtgagtaccactcctttgtgctttaccataacaacagtcccaggtggtctgaactgctgaaacttcccattcctgtggataaattccggggtgcacacatccgcttcgagtttcggcattgttccacaaaggagaaaggagagaagaagttgtttgggttttcttttgtccctctgatgcaagaagatggtaggactcttccagatggcactcatgagctcatcgtgcataagtgtgaagaaaacacaaatcttcaggatactacccgctacctcaaacttcccttttccaagggcattttccttgggaataataatcaagccatgaaggccacaaaggagtccttttgtattacatcttttctctgttccacaaaactcacacaaaatggtgatatgcttgatcttttgaaatggagaacccacccagacaagatcactggctgtctctctaaattaaaagaaattgatggctcagagatagtaaagtttctgcaggatacactggataccttatttggaattttagatgaaaattcccaaaaatatgggtctaaagtgtttgattctttggttcacataataaatttgctgcaagatagcaaatttcatcattttaaacctgtaatggacacttacattgagagtcattttgctggggcacttgcatacagagatctcatcaaagtgctcaaatggtacgtggaccggatcacagaagcagagcggcaagagcatatccaggaggtgctgaaggcacaagaatacatttttaagtatatagttcaatctcgaaggctgttttcccttgccactggtgggcaaaacgaagaggagttccgctgctgcattcaggagcttctcatgtcagtccgtttctttctttcgcaagagagcaaagggtctggagcattatctcagtcacaggctgtgtttctgagctctttccctgccgtgtactcagaactgttgaagctctttgatgtccgggaagtagccaacttggtccaggacaccctgggcagtctgccgaccatcctgcatgtggatgattccctgcaggccatcaaactgcagtgcattggcaaaaccgtggaaagccagctttataccaacccagattcccgatacattcttctgcctgtcgtgttacatcacctccacattcacttgcaagaacagaaggacctgatcatgtgtgcacgtatccttagcaacgtattttgtcttatcaagaaaaatagctcagaaaaatctgtgctggaggaaatagatgtgatagtggccagcttgctggatattctgctgaggaccatattggagatcaccagccgacctcagccatccagctcagcaatgcggttccagttccaggatgtcactggggagtttgttgcttgtctcctgtccctattacgacaaatgacagatagacattatcaacagcttcttgatagttttaatacaaaggaagaactaagggatttcctgctgcagatatttactgtgttccgaatattgatacgcccggagatgtttccaaaggactggactgttatgcgcttggttgctaacaatgttattattacaacagttctatacctctcagatgcacttcgtaagaacttcttaaatgaaaactttgattataagatctgggattcctacttttacctcgcagtcatttttataaaccagttgtgtctgcagttggagatgttcacaccttccaagaagaaaaaggtgttagaaaagtatggtgacatgcgggtaacaatgggttgtgaaattttcagcatgtggcaaaacctaggagagcacaagcttcattttatccctgccctgaggcaggagaatcgcttgaacctgggaggaggaggttgcagtgagccgagagcatgtcactgcactccagcctgggcaacaaagcgagactgtgtctcaaagaaaaaagaaaaaaagacatgatttgagggtctgttttaaaattatctttacttatgtacatatcagaaagtttccaaaggtattttttttatacaagaaaaatgtagtttttagggattttagagccagtataactcctgcaagcaaacattttatttaaacactactaatatggcatttatgatagttcagtaagactaagctgaaattttcctcaccactatctttggaaaggagacataacacttatttccaaattcatgctttgaacatacttgtacagataacaagaaggcatattttatgccttttagacgcactcgcctgtttttgggccctaggctggaagtcattctacttatacctcaatgaaggaatgcactgctaactggtacgaagtcacagtgtatagctgaatctaacacgaaggcattcctttggcaggagtcaaaatctcagacttttcattaattcatgcagacttctttgtcaatctaagttattaagattttctatattgttaaacggactttttgttgctaatttgaaaaaaagttgatgattttgtttcaaatacgtcagtgtcgtgggaagcctttaatcagggtatgataatagctccctgtgtgtttccagccaagtccatctacctcaagcttgagttctactcactcggcttcacctaatgtgacaagttctgctccatcgagtgccagaggtcagtgccagagtgtggggaagactgagggtgcccagagaaccttctagtcctgggaactgtggccagctgccacacgttcaggctctcgcctccaaacaggtgcagcaccactaccatgctgatgatcctctctctccttctcttcccagcttctcctttgttgtctgacaaacacaaacattcccgagaaaactcttgcctgtcaccaagagagagaccatgcagtgccatctatccaacacctgtggagccttcgcagaggatgctgtttaatcatattggagacggggccttgccacgcagtgacccaaatctctctgcacctgaaaaagctgtgaaccccacccctagcagctggagcctggacagtgggaaggaagccaagaacatgtcggatagtgggaaacttatctctccccctgtccctccaagacccacacagactgcttcaccagcaagacacacgacatcagtatccccctcgcctgccgggcgatctccattgaagggctctgtgcagtctttcaccccctctccagtggagtaccactcgccaggactcatctccaactcccctgtcttgtcgggcagctacagcagtgggatttcttctctcagccggtgcagcacgtcggaaacctcaggctttgaaaatcaggtgaatgaacagtcggcccccctgccggtgccagtgccggtgcccgtgccgagctacggcggggaggagccagtgcgcaaggagagcaagactccgcccccgtacagcgtctacgagcggactctgcggcgccccgtcccgctacctcacagcctctccatccccgtcacgtcggagccgcccgcgctgccccccaagcctctggcagcgcgatccagccacctggagaatggggcccggaggactgaccccggcccgcggcccaggcccctgccccgcaaggtctctcagttataag

SEQ ID NO: 125839 - DNA, 10075 bp, Homo sapiens
  Payload ID: 4654
  Gene Symbol: DOCK5
  Gene Name: dedicator of cytokinesis 5
  Uniprot ID: Q9H7D0
  ENST ID: ENST00000276440
  CDS Start-End: 45-5657
tgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcaaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgttggtatgagactgtcaaggtatccattgctatagaagaagtcacacgctgtcatataagatttaccttccgacacaggtcatctcaggaaaccagagataaatcggagcgagcatttggggtggccttcgtgaagctgatgaacccggatggcaccactctgcaggatgggaggcacgatctggtggtttataagggtgacaacaaaaaaatggaagatgctaaattctacctgaccctgcctggaaccaagatggagatggaagaaaaagagcttcaagcatccaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaagggggcagctttgaagtaccttcctagcataattaatgatgtcaaacttgtatttgatcctgttgagctcagcgtgctcttctgcaaattcattcaaagcattcctgacaaccagctggttcggcagaaacttaactgcatgaccaagatagtagagagcactctttttcgacagtcagagtgcagagaagtgctgctgccactgctgacagaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagtgtgagttcaatttcagtggaaatggcaatttccatatgtttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcagtggtctgacaagccctgtgtgcctcatttgcttcagaaggacagttactatgtttatacccagcaagagcttaaagagaagctgtatcaagaaatcatatcatatttcgacaaaggcaaaatgtgggagaaggccatcaagctgagcaaagagttggctgagacttacgaaagcaaagtatttgactacgagggccttggcaacctcctgaaaaaaagggcctcattttatgagaacatcattaaggcaatgaggcctcagcctgaatactttgctgttggatactatggacagggctttccttctttcctacggaataaaatcttcatctatcggggaaaggagtatgagaggcgagaggacttcagcctgaggttgttaacccagttccccaatgcggagaagatgaccagtaccacgcctcctggggaagacatcaagtcgtcccccaagcagtacatgcagtgcttcactgtaaagccagtgatgagcttgccgcccagctacaaggataaacctgttccagagcagatcttaaactactacagagccaatgaagtgcagcagttcagatactcccggccgttccggaaaggagaaaaggatccagacaatgaatttgctacgatgtggattgaacggaccacgtatacgactgcatatacctttcctgggattctcaagtggtttgaagtcaaacagatttcaacagaagagatcagtcctctggagaatgccatcgaaaccatggagctgaccaacgagaggatcagcaactgtgttcagcagcatgcctgggaccggtccctctctgtgcaccctctctccatgctgctcagtggcatcgtggacccggccgtcatggggggcttctccaactatgaaaaggctttttttacagaaaagtacttgcaggagcatcctgaagaccaggagaaggttgagctgctaaagcgactaatagcattacagatgcccctgctaacagaagggatccgcatccatggggagaaactcacagagcagctgaagccgctgcatgagcggttgtcttcttgcttccgggaactcaaggagaaagtagaaaagcactatggggttataacactgccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatggctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagcaccagaacccgatttgatgagcccaaccagaaaagcacaaaggccaaagagtctccagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatcttggaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgattatttattcctcttgattgtggaattaatttgattgcttgctaatggtactagtagtactcctttcagaagaaaaaatggagcgatttaggtgaccaaatattacatacataaatagccacatgaagttttagacgtttggacttgaagcctcaaagatcaaccaaccagtccccttatttagtaaataaggaaattgaggctacacacagaaaattgtgctacagattattactaataacccagcttgctaaattaggctatacctaggtaatctctagaagacaactctgacagactctttaatatttacccctggttggaacaatatttgaaatgtcccagatatttctatgctacttagatatttgtggcaaagcagaaagctttttgactgtgaaggcagaggtcagcactgggggaaacttgctggtggtctctcccacaaccttgcccagagtcctttccactaaggaggtgaagagaacagagaaagagatttccatttctgctgccagagctggtatttgcctgcctgattctctgtgtttcctgtttcaccgccaccctttcaggagagaactacaccagttcatcatgagggtcagggaagcaaaagctctcagatgtgtccagggcgttacttaagaaatgagtatgcagattctggaaggggtgtggaaaaggtgatcctttacccccacccaggaaaacctgcattgtgctagcatggaagaatcatgggctttggaattaaacccatttggtggaattaaacccatttggtttcaaatcccagttatgacatctgttaactttgcaaactcacaaaaattatttgaaattatctgagttttcattttctcaccttccagaatggggataatgcctcctgcatcggttgttgtgaggtttcaatgagatgaaatatgggaaagaagaggtactcacctgatggtccctgctttcctctgctaggcctgagtaggaactggaactctctaagagcattactcatactttttttttcttccaaggtagtttggaatgtgagtgcaagttagttctgcacatacagcccttctccaaatggtggtttcctttgaggtcttttacatgattatttatgactagagacaaacttaataagaactcaagaggattttaaatggagagaactcaagctgtagagaaaggaggaggcaacagacaggatatgtaggggcttacctagagcctggcacgacttctgagaagtcacccagcagaccggctagaggggatttgtgtgccacactctacttgccgggctgccattaaaatagaaagatataaaactgggtcaccaaaaaaaccaaacctcaaggctatccttccagagcagtagaaatgagtcccacagcctggtctttgagcagaggctgggaagataggatacatcactgtctggataccttctctttttaatagaatatattccgtatgattccctttccaccttaatggaaataatagctctctcctgcctgaacaaaagggattccaggtagtattgtggctaagagattacagcggacgatggaaggttcattttttagggaaggtgttgggtaggaagagtcacatttgacagaattcataaataatgtgtcctgaagtcagaggatgactgcaaagaaacacctcatgattccattaaatataaagagataaggagcaaggaggaaaaaagagaaagaattggtctttatttttcttgctaagaactctctggagtattgaaagacattgaaattatccctaaaattgtcacaacttttgtgaatactggtatacggttggaggtgtttttaaatctttatttcctctctttctttgttctagtgacttgtcttgctttaagattttttttaaaggattgttttattcaacatatatcaagttcttatggaatgccagtcatggtactagccccttgggatgtagtggttgagtgtgttcaatggaaacagccccagtatacaaagacagttcactctggtgtgctgtaggattggaaagggagtggtaccagatgaaaatgaaaccctaaagaagactgctgggccatgagttgcttcctcctcctccaccttaaccctctgattccagaattgcagtcattttcttctgccaaggaaatccattaaaaactgcagccacactgcaatttcctaatgtagaacaagatataaagcaggctttgagacaacaacctacctttgtttactctttccaagctggaagagtccttctcctctagttgcccctaggtcactggctaatttattttaaaatttagatggaactcatgtatagttaagtgcacaaatcttagccgtgcagatgggtaattttcacatagctatttgcccacatccgtgcctctaagatagagacatacactgttttcagcaccccagaaagttcccacatgcccatggtgccattttgtgaaaggtatttataaggcccttcaaatttgtggcttcctttctcatacttctcaggtataatgaaagggggagaaaaaccccaccatcaacacaaaacaaggctataaagactgtgcaccttttaacaagtcaatttgtagtcagtccctgggcctgtctttttttttttttaattttgaagctacctgaggtttagaattccttcagccctagctgcttttattctgctttttatttaaacaaaaagagggggaggatctgaaggaaactagttttctgtacaaaggctttgaggtccatggactatacttgtcccatttatcatcccaggtggtgctttgaccctgccataccctggctattaagataaaaagatttgtggacattaaaattatgaatatgtcagtaataatccagcacacattgaaatattgacacagattaccataatttgtgcaacatcttataaacaatgtcatttccatagtagtctaaggcttcaccagcctggcccactgtatctagactttaggttcattttaataattatgctttccttctctgtatcatttgggaagttgataaatatcacttccttagataccttcattcagtgatatatctggcttttacaattaaattggaaaaggtaagtttctctttggtgggttgagagttggaccatcaattctaatctacaaaaggaaattcatgatttcactctgacgcctaggatctagccaaggctggtctgcagtatcagatgtccaaactcatctactattagccatattttgtgagtcgtttgtctaaactttgtcaaaaatgcctttgccatgattttgttgctatctggatttcaaacatggacagttaggaagatgtgcattgaagtaggaaaattttgttcagatttgctgttatttattttttaaattaaaaatggaaatgtattttaaagttta

SEQ ID NO: 125840 - DNA, 786 bp, Homo sapiens
  Payload ID: 4654
  Gene Symbol: DOCK5
  Gene Name: dedicator of cytokinesis 5
  ENST ID: ENST00000410074
  CDS Start-End: 187-438
gcgggcggcgcgggcacgggcacgggcgcgggcggcgcggcgaggaggcggcccgcggagtccagcgaagtttggcggaacatggcggaagcgtctggggcacgcaggagcgcggggcggcggcggccggagcccgaggagctgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaaggcaattggttccaggacccccacaataccgaaatccatggatgctcaagtctctgatataaaatggcatagtatttgcatataacctctgcatttcctcccgtgtactttaaatcatgtctagattatttataatacctaatacaatgtaaatgctatgtaagtagttattataccgtattgtttagggaataatgacaaggaaataaacctctgcttactttttttttctatatttttaatcatcagttggttgaacccatgatatggagggccttgtgtatataaaaatcagtctagctaatagtgccattgttgttggctttgaacagtagatagatagggttcccccaggatctaaatgataaattctggattttttttaaatttttttgtgttcattaaagagtgcttaaaacctttaagcttaaaa

SEQ ID NO: 125841 - DNA, 5335 bp, Homo sapiens
  Payload ID: 4654
  Gene Symbol: DOCK5
  Gene Name: dedicator of cytokinesis 5
  ENST ID: ENST00000444569
  CDS Start-End: 1-3271
agtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcaggaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcaaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggcctttgggtatccttgaagctcttgcccggtgacctcacccaggttcagaagaatttttcacacttggttgatagatcaacagcaatagcccggaagatgggctttcctgaaatcatactgccaggagatgttcggaatgacatttatgtcaccctgatccacggtgagtttgacaaagggaagaagaagacgccaaagaatgtggaggtgacgatgtctgtgcacgatgaggagggcaagctcttggagaaagcaattcaccctggtgctggatatgaaggcatttcagaatacaaatcagtagtctattaccaagtcaagcagccctgttggtatgagactgtcaaggtatccattgctatagaagaagtcacacgctgtcatataagatttaccttccgacacaggtcatctcaggaaaccagagataaatcggagcgagcatttggggtggccttcgtgaagctgatgaacccggatggcaccactctgcaggatgggaggcacgatctggtggtttataagggtgacaacaaaaaaatggaagatgctaaattctacctgaccctgcctggaaccaagatggagatggaagaaaaagagcttcaagcatccaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaagggggcagctttgaagtaccttcctagcataattaatgatgtcaaacttgtatttgatcctgttgagctcagcgtgctcttctgcaaattcattcaaagcattcctgacaaccagctggttcggcagaaacttaactgcatgaccaagatagtagagagcactctttttcgacagtcagagtgcagagaagtgctgctgccactgctgacagaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagtgtgagttcaatttcagtggaaatggcaatttccatatgtttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcaggtgaatggctcagagagcttgtttcaacagggtggagtacagtgtcctttcagactaaattctatacatttcatgattttgatgggaaagaactttattccaggaatatccttttatacaagtttttttagttctttctaaataggcacagctaatttgtagatcaagtatgggaaaatgtcagttatcttttatttaaaaatccttagaaagcagagcacgacttatgaacctttggtaattgacactctaattaaagcaataaaacacacattgatgaatacataaaaaaatttgtaaaactgcagaaaactgcagaaagatgagttataagtgaatatagtaccatagaagtactctatttttattctctccctaaataaatgtatgttgtggtttagatataaatacatctatatgttatgaatcccaagtaattatttctagccctgagcaccttctctaactttggatttacatataaactttgattggccaatatgcagctcaaactgaacaaggcggtaacaggaacctttatttctcactctttgctcctccccagcccatcctacctcactttgttaccatgttactaataacattcccatccatttagttgctcaggcaacctcatagtcatcttcaatttctctcttttactcaccacctcccacattctccacaagcgagagatgtggcccctctgttcagaacatgcccctaacttatccgcttttctttttctttctttatttttttttttaaagagatgagatcttgctatgtttcccaggctggtctcaaactcctgggctcaagcaatcctcccacttcagcctcccagagtactaggattacaggcatgagccaccatgctagccaatccacttttctttatctccctgactaccaccttggtccatcccgtaagcatgtcacaccttgagcactacagcagcctcctgtttggtgtctctgcctccagttttgttctcagctattaatattcttttacagtttatattttatactaaagtaatatatgggcattgtccgaacatatgagttaaaaataggattcctatgcctcaccacttcccaaaggaaattcacaattcatatttaagtttagggcattaaaaagcttattgtataatggactgggcctggtggctcacgcctgtaatcccagctctttgggaagctgaggccagcagatcacttggggtcaggagttcaagaccagcctggctaacatggtgaaaccccatctctactaaaaatacaaaaaattagcaggcgtggtggcacctgcctgtagtcccagctactcaggaggctgaggcaggagaatcatttgaacctgcaaggcggaggtttgcagtatgctgagatggtgccaccatactccagcctgggtgatagagcaagactgtgtctcaaaagaaaaaaaaaaaaaaaaagcaacctactgtatatagcttagaaagtgaggcttgttgactgtggatttcgccattgtatgatcagaaagaaatccccagtgtctgtaactgtaggtcttttcatttgggaaactcaggaaggtaaactctcctatcctggtgtaagatatgaggtatgaatgcagctttttttccccccagattgctattcaatagagatgctgtttgttaagtatagttcacattttgcttattggtataagatcccatctttattactaaattcttattttggggggagggaatctctttctagattgtatatgcttttacgtgggtctctgtctgttcatgtaccagtaccatactgtattaattattaattcttgatagtgtgttttatgacctggtagttactcttgattgctcttctttttcagagttttcctacctattcctttttgttaatttttccatatggactttggaaagatgaaatttaaaaattaatttagtgagaatttacatgttaatgaaatagaattttcttatccaaaagcatggtatgactttccatttgttcgagtctgcttttgtgcccttcaatggcgtgtgaaagttttctgcatataagtcttgcatattccttgtaatgttcactcttagaaatgttctttttggacttatttttgtttggttccattcttctattctgtatatttagtctccgtgtatctgaaataaattttatttcaag

SEQ ID NO: 125842 - DNA, 4844 bp, Homo sapiens
  Payload ID: 4654
  Gene Symbol: DOCK5
  Gene Name: dedicator of cytokinesis 5
  ENST ID: ENST00000467709
  CDS Start-End: 1-415
gatggaagaaaaagagcttcaagcatccaaaaacctggtcaccttcaccccaagcaaggatagcactaaagacagctttcagattgccaccctcatctgctccacaaagctcacccagaatgttgacctgttaggcttgttaaattggcgttccaactcccagaacattaaacacaacctaaagaagttaatggaagtggatggaggagagattgttaagtttttgcaagatacactagatgcactctttaacataatgatggaaatgtcagacagtgaaacctatgacttccttgtgtttgacgcactggtatttattatttcactgataggagacatcaagttccagcattttaatcctgtacttgaaacctacatttacaagcacttcagcgccactttggcatatgtatgactccagcaagactgaactgctttttgctgcgttgaaagccttgaagtacttgtttagattcatcatccaatcccgagtgctctacttgagattttatgggcagagcaaagatggagatgagtttaataattcaattcgccagttatttcttgctttcaatatgctgatggacaggcctctggaggaagccgtcaagatcaagggggcagctttgaagtaccttcctagcataattaatgatgtcaaacttgtatttgatcctgttgagctcagcgtgctcttctgcaaattcattcaaagcattcctgacaaccagctggttcggcagaaacttaactgcatgaccaagatagtagagagcactctttttcgacagtcagagtgcagagaagtgctgctgccactgctgacagaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgggagttttgtggcttgcatgattgccctgctgcagcaaatggacgacagccactatagccactacatcagcactttcaaaaccagacaagacatcatcgacttcctcatggaaacttttatcatgttcaaggacctgattggaaagaatgtctatgccaaagattggatggtgatgaatatgactcaaaacagggtttttctccgtgctataaatcagtttgctgaagttctcacaagattcttcatggatcaggcaagctttgaacttcagctctggaacaattacttccatttggcagttgcatttctcacccatgagtcccttcagcttgaaaccttctcacaagccaagcgcaacaaaattgttaaaaaatatggggacatgagaaaggaaatcggctttagaatccgggacatgtggtataacctgggtccccacaaaatcaaattcatcccatccatggtgggtcccattctggaggtcactctgacccctgaagtagagctccggaaagccacaatccccattttctttgatatgatgcagttttgagaatgagctgatcacaaagctggaccaggaggtagaagggggcagaggagacgaacaatacaaggttcttctggaaaaactgctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctgaacttttataaagaaaagaagagagaggacatatacataagatatctgtacaagcttcgagatttgcaccgagactgtgagaactacacagaagctgcctacacgcttctcttgcacgctgagcttctgcagtggtctgacaagccctgtgtgcctcatttgcttcagaaggacagttactatgtttatacccagcaagagcttaaagagaagctgtatcaagaaatcatatcatatttcgacaaaggcaaaatgtgggagaaggccatcaagctgagcaaagagttggctgagacttacgaaagcaaagtatttgactacgagggccttggcaacctcctgaaaaaaagggcctcattttatgagaacatcattaaggcaatgaggcctcagcctgaatactttgctgttggatactatggacagggctttccttctttcctacggatgggtccagactgtttgcagactggccatggtccttgggccacactggaagaagaactgggctaagtattttttatgcctgtgatttaacttctccaataaaccgcagctcttgtaggatatgatggtcgctaataaaatcttcatctatcggggaaaggagtatgagaggcgagaggacttcagcctgaggttgttaacccagttccccaatgcggagaagatgaccagtaccacgcctcctggggaagacatcaagtcgtcccccaagcagtacatgcagtgcttcactgtaaagccagtgatgagcttgccgcccagctacaaggataaacctgttccagagcagatcttaaactactacagagccaatgaagtgcagcagttcagatactcccggccgttccggaaaggagaaaaggatccagacaatgaatttgctacgatgtggattgaacggaccacgtatacgactgcatatacctttcctgggattctcaagtggtttgaagtcaaacagatttcaacagaagagatcagtcctctggagaatgccatcgaaaccatggagctgaccaacgagaggatcagcaactgtgttcagcagcatgcctgggaccggtccctctctgtgcaccctctctccatgctgctcagtggcatcgtggacccggccgtcatggggggcttctccaactatgaaaaggctttttttacagaaaagtacttgcaggagcatcctgaagaccaggagaaggttgagctgctaaagcgactaatagcattacagatgcccctgctaacagaagggatccgcatccatggggagaaactcacagagcagctgaagccgctgcatgagcggttgtcttcttgcttccgggaactcaaggagaaagtagaaaagcactatggggttataacactgccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatggctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagcaccagaacccgatttgatgagcccaaccagaaaagcacaaaggccaaagagtctccagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatcttggaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttga

SEQ ID NO: 125843 - DNA, 2166 bp, Homo sapiens
  Payload ID: 4654
  Gene Symbol: DOCK5
  Gene Name: dedicator of cytokinesis 5
  Uniprot ID: Q9H7D0
  ENST ID: ENST00000481100
  CDS Start-End: 138-1190
ggcccgcggagtccagcgaagtttggcggaacatggcggaagcgtctggggcacgcaggagcgcggggcggcggcggccggagcccgaggagctgtagcagccttagtcgccgccgccgcggggcgaggtcgccgccatggcccgctggatcccgaccaagaggcagaagtacggggttgcgatctataactacaatgcttctcaagatgtggagctctccttgcagatcggtgacacagttcacatcctggagatgtacgagggttggtacagaggatataccctccaaaataaatctaaaaagggcattttccctgaaacatatatccatttgaaagaggcaactgtggaagacctggggcagcatgaaaccgtgattcctggcgagctccccctggtgcaggagctcacgtccactctgcgagaatgggctgtcatctggcgaaagctctacgtgaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacagaatgctggggttagatctggtggtgcgagatgacaatgggaacatcctagaccctgacgaaaccagcaccattgccctcttcaaggcccatgaggtggcctccaaaaggattgaggaaaagatccaagaagagaagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcagtgagaactatctaattcgttggggcagtaacgggatgcccaaggaaatagagaagctcaataacctccaagcagtgtttacagaccttagcagcatggacctcatccggccccgcgtcagccttgtgtgccagattgtccgcgtgggccatatggagctgaaggaaggcaagaagcacacctgtggactccgaagaccttttggagtggcagtgatggatattactgatatcatacatgggaaggtggatgatgaagaaaagcagcattttattccctttcagcagtaagtactttggcatgtgtcccaggtgacttgagacctggattagccattcaattgtcttttaacacagaaacaggtgttagaaaccattttctcagagaaggaaagattctaagctgcaagattgtcagataggagctgaacagaagactttattcaaagtccttgatgttggactcccattgaagagggtaaactgaactttcctgattctatagaaagcatcaaaggaatataaaagggcacatatctgtctgctctggaatgcagagagggtgccgtccttgtgtcagcaatgccaaaatatatgtgcagtctattgcatgaaacaggcatcatggatgacacggaatcacgtgggctagcatagggcttctcagactgcatcatgcatatgaatcaggggaacttgttaggctgcaggggagttctgcctctgacaagctcccaggtgatgctgatgtagctggtctgagggccacactgtctgtagcgagggtttaggagatgagagagtgaagggctgacccacccatgggccagtgttcctgcatgttgggggaaagccagcctgggagcatgtgaaaggatccttgcagagctttactgaggccctccatattgagctgcaggagctggagccatgggtaggccattgaggagctgttgggagcagattcaagccgtgtcactctgaagaagtgcaggtgtgaacgtcatgacctgctccagcacctgcacaggcagtggaggcctagtggaggccaagagcattgccgggaccaagtcccaccaggggccatcgtgccagtcagagggcatcatctcagctcacttgcagctgccactgcagacaagtagaacaaactgagaattccacaaaccagccagagtcatatatttgagttaatatatcactttttacaaatgatatcacaaattagtggagaaagatacattatgcaaaaaaaaaaaaaaaa

SEQ ID NO: 125844 - DNA, 6358 bp, Homo sapiens
  Payload ID: 4655
  Gene Symbol: DOCK6
  Gene Name: dedicator of cytokinesis 6
  Uniprot ID: Q96HP0
  ENST ID: ENST00000294618
  CDS Start-End: 13-6156
gacgcgaggaccatggctgcctccgagcgccgcgccttcgcgcacaagatcaacaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgaaaaactggatgcccaggtgagggccgcggtggagatgtatattgaggactgggtcattgtccacagaaggtatcagtacctgagtgcagcatacagccccgtcaccacagacacacagcgggagcgacagaagggcctcccccgccaggtctttgagcaggatgcttctggagacgagaggtccggccctgaggactcgaatgactcccggcgtggctcgggctccccggaagacacccctcgaagcagtggtgcctctagcatcttcgacctgaggaacctggcagctgactcattgctgccctctctgctagagcgggcggccccagaagatgtggaccggcgcaatgaaacccttcgacggcagcaccggcccccggccctgctcaccctctacccggcacctgacgaggatgaagccgtggaacgctgtagccgcccagagccaccccgcgagcactttggacaaaggatcttggtcaagtgtctgtcgctcaagttcgagattgaaattgagcccatctttgggatcttggctctgtatgatgtgcgggagaaaaagaagatctcggagaacttctacttcgacctgaactcggactccatgaaggggctgcttcgggctcatggcacccaccctgccatctccaccctggcccgctctgccatcttctctgtgacctacccctcacctgacatcttcctggtcatcaagttggagaaggtgcttcagcaaggggacatcagtgagtgctgtgagccttacatggtgttgaaagaagtggacacagccaagaacaaagagaagctagagaagctgcgcctggcggccgagcagttctgcacccgcctgggccgctaccgcatgcccttcgcctggacggccgtgcacttggccaacatcgtgagcagcgctgggcagctggaccgggactctgactcggagggcgagcgccggccagcctggacagaccgccgccgtcgggggccccaggaccgggcgagtagtggggacgacgcctgcagcttctctggcttccgtccagccacgctaactgtcacaaacttctttaagcaggaggctgagcgactcagtgacgaggacctcttcaagttcctggctgacatgaggcgcccgtcgtccctgctgcggcgactacgtcctgtgactgcccagctcaagatcgacatttctccggctcctgaaaatccccacttctgcctctcccctgagctgcttcatatcaagccctacccggaccccaggggccggcccaccaaggagattctggagttccccgcccgcgaagtctatgccccccataccagctacaggaacctgctgtacgtgtacccgcacagcctcaacttcagcagccgccagggctccgtgcgcaaccttgctgtgcgagtgcagtacatgacaggcgaggaccccagccaggctctgccggtcatctttggcaagtccagctgcagtgaatttacccgcgaggccttcacaccggtggtctaccataacaagtcccccgagttctacgaggagttcaagctgcatcttccagcctgcgtgacagagaaccatcacctgctgttcaccttctaccatgtcagctgccagccccggccgggcactgccctggagacacccgtgggctttacttggatcccactgctgcagcacgggcgcctgaggaccggccccttctgtctcccagtgtctgtggaccagccgccgcccagctattccgtgctcacacccgatgtggcgcttccgggcatgcgctgggtggacggtcacaagggcgtgttcagtgtggagctcacagccgtgtcctctgtgcacccccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggatttgctgtacctttgcctagctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccggagaatgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaacgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 125845 - DNA, 554 bp, Homo sapiens
  Payload ID: 4655
  Gene Symbol: DOCK6
  Gene Name: dedicator of cytokinesis 6
  ENST ID: ENST00000585904
  CDS Start-End: 1-554
ctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagggcatcgatcgctcacactcctgggtgaattccgcttatgctccaggaggcagtaaggctgtgctgcggcgggcgcccccttattgtggggccgaccccagacaggccatcgactgcaactctagccgagcctcctcctacctcgagggttcctcctcggccccaccagccacccagctgagacccactgtgcagaagctgcttcacgaggagctggctctgcagtgggtggt

SEQ ID NO: 125846 - DNA, 1391 bp, Homo sapiens
  Payload ID: 4655
  Gene Symbol: DOCK6
  Gene Name: dedicator of cytokinesis 6
  ENST ID: ENST00000590680
  CDS Start-End: 1-1391
tgtacccgcacagcctcaacttcagcagccgccagggctccgtgcgcaaccttgctgtgcgagtgcagtacatgacaggcgaggaccccagccaggctctgccggtcatctttggcaagtccagctgcagtgaatttacccgcgaggccttcacaccggtggtctaccataacaagtcccccgagttctacgaggagttcaagctgcatcttccagcctgcgtgacagagaaccatcacctgctgttcaccttctaccatgtcagctgccagccccggccgggcactgccctggagacacccgtgggctttacttggatcccactgctgcagcacgggcgcctgaggaccggccccttctgtctcccagtgtctgtggaccagccgccgcccagctattccgtgctcacacccgatgtggcgcttccgggcatgcgctgggtggacggtcacaagggcgtgttcagtgtggagctcacagccgtgtcctctgtgcacccccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaaggccatcgactgcaactctagccgagcctcctcctacctcgagggttcctcctcggccccaccagccacccagctgagacccactgtgcagaagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaag

SEQ ID NO: 125847 - DNA, 444 bp, Homo sapiens
  Payload ID: 4655
  Gene Symbol: DOCK6
  Gene Name: dedicator of cytokinesis 6
  ENST ID: ENST00000588666
  CDS Start-End: 1-444
ccgccacctgcccgtgggctgcgtttccttccagaacatctcatccaacgtgctagaggagtccgccatctccgacgacatcctgtcgcccgacgaggagggcttctgctccgggaagcacttcactgagctggggctggtagggttgctggaacaggcagccggctacttcaccatgccccagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgataccta

SEQ ID NO: 125848 - DNA, 312 bp, Homo sapiens
  Payload ID: 4655
  Gene Symbol: DOCK6
  Gene Name: dedicator of cytokinesis 6
  ENST ID: ENST00000587734
  CDS Start-End: 1-297
cgtaagacgctgctcagcaccgaccacgccttcccctacatcaagactcgcatccgtgtgtgccaccgggaggaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggttttt

SEQ ID NO: 125849 - DNA, 4009 bp, Homo sapiens
  Payload ID: 4655
  Gene Symbol: DOCK6
  Gene Name: dedicator of cytokinesis 6
  ENST ID: ENST00000587656
  CDS Start-End: 1-4009
gctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagggcatcgatcgctcacactcctgggtgaattccgcttatgctccaggaggcagtaaggctgtgctgcggcgggcgcccccttattgtggggccgaccccagacagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggatttgctgtacctttgcctagctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccggagaatgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaacgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctga

SEQ ID NO: 125850 - DNA, 7084 bp, Homo sapiens
  Payload ID: 4656
  Gene Symbol: DOCK7
  Gene Name: dedicator of cytokinesis 7
  Uniprot ID: Q96N67
  ENST ID: ENST00000251157
  CDS Start-End: 1-6396
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaattgcagaactttacttagtaaaacctttgtgtaaaataatttaaatacggggataactaataccagtgacaacaccttaacttgattaaatcttattacaccaa

SEQ ID NO: 125851 - DNA, 6731 bp, Homo sapiens
  Payload ID: 4656
  Gene Symbol: DOCK7
  Gene Name: dedicator of cytokinesis 7
  Uniprot ID: Q96N67
  ENST ID: ENST00000340370
  CDS Start-End: 1-6330
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcggtacgtacacaatagcttctcctcctgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacact

SEQ ID NO: 125852 - DNA, 2678 bp, Homo sapiens
  Payload ID: 4656
  Gene Symbol: DOCK7
  Gene Name: dedicator of cytokinesis 7
  Uniprot ID: Q96N67
  ENST ID: ENST00000404627
  CDS Start-End: 105-2003
ggcggaggccgcgagggagggagcacgagcgaggaggcacgcgcccgccggtccgcacccggcccgccgcagccgccgccgccgtcgccgtcgccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccgagccccagctgcacccatcctataccgacagttagacctctccctctttggtgctaccatagcatcttctcacttctttcatgggactttatcacttgatgattctatatttcttaatttcacccattagattgtgagctccttgagggcagggacgatgtcttactcatgtctatatcttgactcctgtcacatttttggataaataattaatgctcaatccatattgctaaatgattaaaagtacatgtcaaatggtcaaaaaaggaacactgtctgctttatgtcatattatgaaaataaacaagttattttgtgaaaagtgatagcttctcagagggaaaaaaggtattgcatttcttttacttgtgtgttattagtcatatgaaaatacaatgtttttatgtatgaaatggctgatttgaaagagtatataaacatagacatactgtgtttgccttttttaaaaaaagggctgtttaaatgggtcctaagataactttttgataatgtaatattgacatgataaaattgtaaacttcataattctggcacaggaacaatttatgaaaacatactaaggtatttgtaaattgatgaaataatatatatcttaggaaagtcataattattacacttgtacatacccttaaaataaaagagcctgcttgaaatgttgcaaaaagaaacagaaatacctgctaatatgcccttctaattaaggatgatgccaattaatctctttatataaataataaactttgagttgtttta

SEQ ID NO: 125853 - DNA, 6985 bp, Homo sapiens
  Payload ID: 4656
  Gene Symbol: DOCK7
  Gene Name: dedicator of cytokinesis 7
  ENST ID: ENST00000454575
  CDS Start-End: 12-6401
ccgcagcagccatggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcaggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaaactgaatgcacttgttttattcatctgcaaagagccatgtattcaacatcgagtgtgaaaagatctattggaaaacaacatggaatggaattctggaaattattattcattgaagaatgcagtggccaagaaaatatcaaatgtagattgttaacgcttgagaatcatggctatggtttctaatgttctggtaacaagctgttatcttttaagacattttaatgactcaaaggtacactatacatttaccattatttataccatagctaaggttaaaaatttattcactttaagttcgtattttttaatttatattaccatttatagattcattttggaaccattttaaatgtagtaatgcttattttaaaggtactattaaatatgtgaatgtttacactaattttaccgagtgggacttcaaaatttttattattgacaatggcagagaacaattaaagggttgactcaagaactagttccaaacctagcagaataaaaatcatagatagccccaaattaatgagtttggtaactgtttcaaagttattttccatttacatacccaaaacaggaatttagaa

SEQ ID NO: 125854 - DNA, 2460 bp, Homo sapiens
  Payload ID: 4656
  Gene Symbol: DOCK7
  Gene Name: dedicator of cytokinesis 7
  ENST ID: ENST00000614472
  CDS Start-End: 1-2412
atggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccatgatgaagttcgatcaatcatcgggagtaaggctatggatcgaagttgtaa

SEQ ID NO: 125855 - DNA, 681 bp, Homo sapiens
  Payload ID: 4656
  Gene Symbol: DOCK7
  Gene Name: dedicator of cytokinesis 7
  ENST ID: ENST00000634223
  CDS Start-End: 1-139
cactacttacagaaatcttctctacatataccctcagagtcttaattttgccaatcgtcaaggttctgctagaaatataacagtgaaagtccagtttatgtatggagaggatccaagcaatgccatgccggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctg

SEQ ID NO: 125856 - DNA, 765 bp, Homo sapiens
  Payload ID: 4656
  Gene Symbol: DOCK7
  Gene Name: dedicator of cytokinesis 7
  ENST ID: ENST00000634929
  CDS Start-End: 1-765
acaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctc

SEQ ID NO: 125857 - DNA, 6423 bp, Homo sapiens
  Payload ID: 4656
  Gene Symbol: DOCK7
  Gene Name: dedicator of cytokinesis 7
  ENST ID: ENST00000635253
  CDS Start-End: 1-6423
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcggtacgtacacaatagcttctcctcctgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaa

SEQ ID NO: 125858 - DNA, 519 bp, Homo sapiens
  Payload ID: 4656
  Gene Symbol: DOCK7
  Gene Name: dedicator of cytokinesis 7
  ENST ID: ENST00000464312
  CDS Start-End: 1-519
agagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggtattgttctgtcatgtaggaattttggggagatgtttgtgcataaatttttttaatttcagaaaggtagtgattgtactatacatgtatgggagggtgattccaagaaacttaaaaactttaagaataaaaataataaaagcaactataagaatgagaaa

SEQ ID NO: 125859 - DNA, 6303 bp, Homo sapiens
  Payload ID: 4656
  Gene Symbol: DOCK7
  Gene Name: dedicator of cytokinesis 7
  ENST ID: ENST00000634264
  CDS Start-End: 1-6303
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaa

SEQ ID NO: 125860 - DNA, 382 bp, Homo sapiens
  Payload ID: 4656
  Gene Symbol: DOCK7
  Gene Name: dedicator of cytokinesis 7
  ENST ID: ENST00000635088
  CDS Start-End: 1-306
tttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcagtttttttatgacttgcccttttttactttttattatacagagtactggctgggagcggatgtttggcacctattttcgtgttggtttttatggaaccaagttcggggatttggatgaacaagaatttgtttacaaggagcctgcaataaccaaacttgcagagatatctcacagattggagggattttacgga

SEQ ID NO: 125861 - DNA, 745 bp, Homo sapiens
  Payload ID: 4656
  Gene Symbol: DOCK7
  Gene Name: dedicator of cytokinesis 7
  ENST ID: ENST00000634652
  CDS Start-End: 1-745
tcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaagggtttagatcgctccaattcctgggttaacactggtggtccaaaagctgccccatggggatccaaccccagtccaagtgcagaatcaacacagctttttcacgaggagctggctttgcagtgggttgtttgcagtggcagcgttcgggaatcagctttgc

SEQ ID NO: 125862 - DNA, 6297 bp, Homo sapiens
  Payload ID: 4656
  Gene Symbol: DOCK7
  Gene Name: dedicator of cytokinesis 7
  ENST ID: ENST00000635123
  CDS Start-End: 1-6297
atggccgagcgccgcgccttcgcccagaagatcagcagaacggtggcagccgaagttaggaagcagatctccggacaatatagtggttctccccaactgctcaaaaaccttaatattgttggcaatatatcccatcacaccacagtgccccttaccgaagcagtagatccagtggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctttgcttcccaatttacttgatcgaactccaaatgaagaaatagaccgtcagaatgatgaccaaaggaaatcaaaccgtcacaaagaactttttgctttgcatccatcaccagatgaggaagaaccaatagaacggcttagtgttcctgatatacccaaagaacattttggtcaaagacttcttgtaaaatgcttatcactcaagtttgaaattgaaattgaacccatttttgcaagtttggctttatatgatgtcaaggaaaagaaaaagatttcagaaaacttttattttgaccttaattctgagcagatgaaagggttgttacgtccacatgtaccacctgctgccattactaccctggcaagatcagcaattttttctatcacttatccttcccaagatgtttttcttgtaataaagctagaaaaagtcctacagcaaggagacattggagagtgtgcagaaccatatatgattttcaaagaagcagatgccaccaagaataaagaaaaactggagaaactgaagagtcaagcagatcagttttgccaaagacttgggaaatatcgcatgccttttgcttggactgcaatccatttaatgaatattgttagcagtgctgggagtttggaaagagattctacagaagtagaaatcagtactggagaacgaaaagggtcttggtcagagaggaggaattctagtattgttggcagacgatcacttgaaaggacaacaagtggagatgatgcttgtaacttgacgagctttcgaccagctactctcacagtgacaaatttttttaagcaggaaggagaccgcttaagtgatgaagatctctacaaattccttgctgatatgagaaggccatcttctgtcttacggcgactaagacctattacagctcagctcaagatagacatttctcccgcacctgaaaatccccattattgcctaactccggagctgcttcaagtgaagctttaccctgacagtagagttagacctaccagagaaatcttagagtttcccgcaagggatgtttatgttccaaacactacttacagaaatcttctctacatataccctcagagtcttaattttgccaatcgtcaaggttctgctagaaatataacagtgaaagtccagtttatgtatggagaggatccaagcaatgccatgccggtaatctttggtaaatctagctgttcagaattttcaaaggaagcctatacagccgtagtatatcataacaggtctcctgattttcatgaagaaatcaaggttaagcttcctgctactttaactgaccatcatcacttgctttttactttttatcatgttagttgtcaacaaaaacaaaatactcctcttgaaacaccagttggatatacatggataccaatgcttcagaatggacggttgaagactggccagttttgcttgccagtctcattggaaaaaccaccacaggcttattctgtactgtctcctgaggttcctctacctggcatgaaatgggtagataatcacaaaggtgtttttaatgttgaagttgttgctgtttcgtctatccatacacaagatccttatcttgacaaattttttgctctggtcaatgctctggatgaacacctgttcccagtccgaattggggacatgcgaatcatggaaaataacttagaaaatgaattgaagagcagtatttcagcactgaattcatcccagctggaaccagtggtccgatttcttcatcttctgctagataaactgatacttttagttattagacctcctgtcattgctggccaaatagttaacctaggtcaagcatcttttgaagccatggcatcaattataaatcgacttcacaaaaacttggaaggaaatcatgaccagcatggcagaaacagccttcttgcatcatatattcattatgttttccgcctaccaaatacttaccctaattcatcatcaccaggtcctgggggtttgggaggatcagtgcattatgccacaatggctagatctgcggtgagacctgcaagccttaatttaaatcgttctcgaagccttagtaatagcaatccagatatatctgggactcccacgtcaccagatgatgaagttcgatcaatcatcgggagtaaggctatggatcgaagttgtaatcgtatgtcttcgcacacagagacgtcaagtttcttacaaacattaacgggacgcttaccaactaaaaagctttttcacgaggagctggctttgcagtgggttgtttgcagtggcagcgttcgggaatcagctttgcaacaagcctggttcttttttgaattaatggtaaagagcatggtgcaccatttatactttaatgataaacttgaggctccaaggaaaagtcgttttccagaacgtttcatggatgacattgcagctcttgtcagcacgattgctagtgatatagtttcacgatttcagaaggacacagaaatggttgagagactcaatacaagccttgcattctttctcaatgatctgttgtctgttatggacagaggatttgtttttagccttataaagtcctgctataaacaggtgtcttcaaagctttactcattaccgaatcccagtgttctggtgtccttgaggctggattttctacgaatcatctgcagtcatgagcactatgttacattaaacttaccctgcagcttacttactccacctgcatctccatcaccttctgtttcttctgcaacatctcagagttctggattttctacgaatgtacaagaccaaaagattgcaaatatgtttgaattatccgtgcctttccgccaacagcattatttggcaggacttgtgttaacagagctggctgtcattttagaccctgatgctgaaggactgtttggattgcataagaaagtcatcaatatggtacacaatttactctccagtcacgactcagacccgcggtactctgaccctcagataaaggctcgagtggccatgttgtatctacctctgattggtattatcatggaaactgtacctcagctgtatgattttacagaaactcacaatcaacgaggaagaccaatttgtatagccactgatgattatgaaagtgagagcggaagtatgataagccagaccgttgccatggcaatcgcagggacatcggtccctcaactaacaaggcctggcagtttcctcctcacgtcaacgagtggcaggcaacacactaccttttcagcagaatcaagtcgaagccttttgatctgtctactttgggttctcaaaaatgcagatgaaacagttctacagaagtggtttacagatctctcagtcttgcagctaaaccggctattagatctgctttatctctgtgtgtcttgctttgagtataaagggaaaaaagtgtttgaacgaatgaatagcttgacctttaagaaatcaaaagacatgagagcaaagcttgaagaagctattcttgggagcataggtgccaggcaagaaatggtacggcgaagccgaggacagctcgagagaagcccatctggaagtgcctttggaagtcaagaaaatttgaggtggaggaaagatatgactcactggcgtcaaaacacagagaagcttgacaaatcaagagcagagattgaacacgaagcactgattgatggaaacctggctacagaagcaaacctaatcattttagatacattagagattgttgttcagaccgtttctgtaacggaatccaaagagagcattcttggtggagtgctaaaagtgctactacacagcatggcctgtaaccaaagtgcagtttatctacaacactgttttgctacacagagagccttggtttcaaagtttcctgaactcttatttgaagaagagacagagcagtgtgctgatttatgcctcaggcttctccgacactgtagcagtagcatcggtacaatacggtcacacgccagtgcctccctttacctactaatgaggcaaaactttgagattgggaataactttgccagggttaaaatgcaggtaacaatgtcactatcctccttggtgggcacatctcagaattttaatgaagaattcttaagacgttctctaaagactatattgacatatgctgaagaagatctggaattgagggaaacaacatttcctgatcaggtccaggatctggttttcaatctccatatgattctttctgatactgtgaaaatgaaggaacaccaggaggatcctgaaatgttgattgatctaatgtacagaattgccaagggttaccagacctctccagatctgcgattgacctggttgcagaacatggcaggcaagcactcagaacgaagcaatcatgctgaagctgcacagtgtctagtccactcagcagcacttgttgctgaatatttgagcatgctggaggaccggaaatatcttcctgtgggatgtgtaacatttcagaatatttcatctaatgttttagaagaatctgcggtctcagatgatgtggtatctccagatgaagaaggtatctgctctggaaaatactttactgagtcaggacttgtgggattactggaacaagcagctgcttccttctctatggctggcatgtatgaagcagttaatgaagtttacaaagtacttattcctattcatgaagctaatcgggatgcaaagaaactatccacaattcatggtaaacttcaagaagcattcagcaaaattgttcatcaggatggtaagcggatgtttggcacctattttcgtgttggtttttatggaaccaagttcggggatttggatgaacaagaatttgtttacaaggagcctgcaataaccaaacttgcagagatatctcacagattggagggattttacggagaaagatttggagaggatgtggttgaagtaatcaaagactctaatcctgtagacaagtgtaaattagatcctaacaaggcatatattcagattacctatgtggagccatactttgacacatatgagatgaaggacagaatcacctatttcgacaaaaattacaatcttcgtcgattcatgtactgtacaccctttactttagatggccgtgcccatggggaacttcatgaacaattcaaaaggaagaccattctgactacgtctcatgcctttccttatattaaaacaagggtcaatgtcactcataaagaagagatcatcttaacaccaattgaagttgctattgaggacatgcagaaaaagacacaggagttggcatttgcaacacatcaggatcccgcagaccccaaaatgcttcagatggtactccagggatctgtaggcaccacagtgaatcaggggcctttggaagttgcccaggtttttctgtctgaaatacctagtgacccaaagctcttcagacatcataataaactgcgactctgctttaaagattttactaaaaggtgtgaagatgccttaagaaaaaataagagcttaattgggccggatcaaaaggagtatcaaagggaactggagagaaactatcatcgccttaaagaggccctacagccactgatcaacagaaagatccctcagttatacaaggcagtattgcctgtcacctgccacagagattccttcagtcgaatgagccttcgcaaaatggatctctaa

SEQ ID NO: 125863 - DNA, 6124 bp, Homo sapiens
  Payload ID: 4657
  Gene Symbol: DOCK8
  Gene Name: dedicator of cytokinesis 8
  ENST ID: ENST00000382329
  CDS Start-End: 388-5088
agaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaa

SEQ ID NO: 125864 - DNA, 1922 bp, Homo sapiens
  Payload ID: 4657
  Gene Symbol: DOCK8
  Gene Name: dedicator of cytokinesis 8
  ENST ID: ENST00000382331
  CDS Start-End: 601-1920
gagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccaggtaataaaagaattatttaactaaaa

SEQ ID NO: 125865 - DNA, 7452 bp, Homo sapiens
  Payload ID: 4657
  Gene Symbol: DOCK8
  Gene Name: dedicator of cytokinesis 8
  Uniprot ID: Q8NF50
  ENST ID: ENST00000432829
  CDS Start-End: 113-6412
gacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 125866 - DNA, 7237 bp, Homo sapiens
  Payload ID: 4657
  Gene Symbol: DOCK8
  Gene Name: dedicator of cytokinesis 8
  Uniprot ID: Q8NF50
  ENST ID: ENST00000453981
  CDS Start-End: 102-6197
cattttgtctcctgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagatcgccgatcgcaactgcagccgaatgtcttactattgctctggcagtagtgatgctccaagttcacctgcagccccaaggccagccagcaaaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 125867 - DNA, 595 bp, Homo sapiens
  Payload ID: 4657
  Gene Symbol: DOCK8
  Gene Name: dedicator of cytokinesis 8
  ENST ID: ENST00000479404
  CDS Start-End: 398-595
cccgaggctgcggcggtggagccgctggacgcgcggcggctcctgcgctgggcccggcgaggtcctccccaagaatctcggtgctcctggatgtcctcagccgccggggatcccttccccgaacaacctcgcccgctccgccctccaggttcttacaggtggccgggtcccagaagggtgataggcgcctgggtaaccgtgttgggcgcgccacggagtgtctcataaacggctccttcctttgaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccgg

SEQ ID NO: 125868 - DNA, 4788 bp, Homo sapiens
  Payload ID: 4657
  Gene Symbol: DOCK8
  Gene Name: dedicator of cytokinesis 8
  ENST ID: ENST00000483757
  CDS Start-End: 91-1599
ctgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagagaagtcttccaggtttcagctgttgctcattaatgctcaccacagccctttgaggtcgatgcaattatgctttggaaaagctaagtaacttgccaaaggccatgcagctaaaagaagcaaaagctggattcaaatctcagctctctgcctccagagagaacaccctcaatcccgcttaacagacattagctctgcttatttgattggtggcagtggagatgaacagaagtgaacagtgagcagagaggggtctgtaccccacacacatccctgcaccccaactgtcaactgtcttccatcatcatttactatatccacgtccactcctgacagcatcagtggctcagtcttaccgacctgcatcagggttttgggctctgcctctgtttagacagagcacgatttgggaagtgctgctaagtcagccagtggctgagtagaaacagccctgcagtgggcctctgcctgctctgtggctcgtttatcatgtgtctcatctttaaaagttggggctcagtctaggtgcctcctggcctgagcaccccagaattctatgctgatcccttcattgtgacatggcctgtcatctactcttctgggaagaccatctgcacctcactgatacttgaagctcattgagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactagaaaccttctctatgtctacccacagaggctgaactttgtaaacaaactagcatcagcccggaacattacaataaagatccagtttatgtgtggagaagatgctagcaatgcgatgccggtgtcttaagacagcggtggggtcctcttagtcctctctgctcaggcccctggcatgccactgccaggagtgccagatatgcttgtgcagatcctgtggcaaccaagatgcccagccaagagtgactgtgggctaaagtccagtctgttcttcattcactgagccatgggttctggtgttgggattactgcatctagaggaaagagctttttttctctgcacaaaggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcacttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagccagaagttggagaccagcccagggaacataatgagactctgtctctacaaaaaatataaaaattagcagagcatggtggcacatacctttagtcccagctactcaggaagaagctgaggcaggaggatcatttaagcccaggagttggaggctgcagtgagctatgattgcaccactgcactccagcctgggaaacagagcgagatcccatctcttaaaacaaacaaacaaacaaacaaacaccctaaaattccattttcgttttcaggacaatacaaaacttacatgaatgctgaaattatgtgtttctttatagatctttcttcctccctccttgcctctttttatgctctaaacacttattttgtctgcccatttgataatccctcactggtctttacccacttgctaatttatgattcagctgagaatctcttttttaagatggagaagtggtgactgatgcctacgattctagtataataaaggaaataatatata

SEQ ID NO: 125869 - DNA, 537 bp, Homo sapiens
  Payload ID: 4657
  Gene Symbol: DOCK8
  Gene Name: dedicator of cytokinesis 8
  ENST ID: ENST00000487230
  CDS Start-End: 215-537
ttttgtctcctgtaacaatttacgcgccgtgtaactgtgaatctttcaaagctcttgcaggagaactctcttgtagctcaccctgtctgaaaacatactggaaaggaattcaaggaaatgtagttcagcctagccacgttgacacatcatgaagccgtcacaaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctca

SEQ ID NO: 125870 - DNA, 741 bp, Homo sapiens
  Payload ID: 4657
  Gene Symbol: DOCK8
  Gene Name: dedicator of cytokinesis 8
  ENST ID: ENST00000469197
  CDS Start-End: 124-324
cagcgccgaccgacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtattcttcagcggaaataaggaaacagtttactctcccaccaaaccttggccagtaccatcgacagagcataagtacctctggcttcccctctcttcaactaagacggagtttctccatgttgtccaggctggtcttgaactcctgagcttcagtgatctgcctgccttggcctcccaaagtgctgggattacagagggacccttgtaaggactatagtcctctcttcagctgaccttcaggtccccagtcagaaccaagggaaccgactctgtcccttctcatagcacctgaaaaccccgggaaacgaggggaatgctttgctctcagctactgaggttgtcctgtcaccttctcttctgccctcctttgccatggcataggataatcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaagg

SEQ ID NO: 125871 - DNA, 6386 bp, Homo sapiens
  Payload ID: 4657
  Gene Symbol: DOCK8
  Gene Name: dedicator of cytokinesis 8
  Uniprot ID: Q8NF50
  ENST ID: ENST00000469391
  CDS Start-End: 80-6079
tacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagaaaccttctctatgtctacccacagaggctgaactttgtaaacaaactagcatcagcccggaacattacaataaagatccagtttatgtgtggagaagatgctagcaatgcgatgccggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaagcatttccatgaggagcttgcccttcagatggtggtcagcaccggaatggtgagagaaacagtcttcaagtatgcctggttcttctttgagcttctggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccaggcgagctcggctctggactgtaaagacagcctgctgggaggtgttctgagggtgctggtgaattctctgaactgtgatcagagtaccacctacctgactcactgctttgcaacactccgtgctctcatcgccaagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtggaggaacttctctgtaatctgaatagcatcttatatgacacagtgaaaatgagggaatttcaggaagatcctgagatgcttatggatctcatgtacagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacgggaggcttatatgagacagttaatgaggtctacaagctggtcatccccatcctagaagcgcatcgagaattccggaagctgacactcactcacagcaagctgcagagagccttcgacagcatcgttaacaaggatcataagagaatgtttggaacctacttccgagttggtttctttggatccaaatttggggatttggatgaacaggagtttgtctacaaagagcctgcaattaccaagcttcctgagatctcacatagactagaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcagggaccactggaagtagcccaagtgtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggcca

SEQ ID NO: 125872 - DNA, 2206 bp, Homo sapiens
  Payload ID: 4657
  Gene Symbol: DOCK8
  Gene Name: dedicator of cytokinesis 8
  ENST ID: ENST00000524396
  CDS Start-End: 113-265
gacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacagtcatgctctgtcgcccaggctggagtacagtggggccatctcggctcactgcaacctctgcctcccggattcaagcgattctcctgcctcagcctcctgagtagctgagattacaggtattcttcagcggaaataaggaaacagtttactctcccaccaaaccttggccagtaccatcgacagagcataagtacctctggcttcccctctcttcaactacctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacccgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctc

SEQ ID NO: 125873 - DNA, 7526 bp, Homo sapiens
  Payload ID: 4658
  Gene Symbol: DOCK9
  Gene Name: dedicator of cytokinesis 9
  ENST ID: ENST00000339416
  CDS Start-End: 56-6364
gcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggtgagccaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 125874 - DNA, 2514 bp, Homo sapiens
  Payload ID: 4658
  Gene Symbol: DOCK9
  Gene Name: dedicator of cytokinesis 9
  ENST ID: ENST00000340449
  CDS Start-End: 1242-2514
tttgtcttatagtgatgaaataggccagagatttttagtagacttcctctttgtgaagattttctttttctgttaacattgttcttttctggggatatttgagaaattttcagaattacattttatgttaagaagtaaacatgtatgttttctttttaaaagaagcaaatttagaatttttgcattttcctcctattaatattttctatttttcattgaaatgtggtagcacttaaagttctctaatcttaactgttttattttttatcacaacagtaattttatatttgagttttggagtactaaatgcaagtatatacaaggtgtccttataccagcaacgtcttctaccttgacttggattctccctgactttgtcccatgaagatgggcaaacagtaaattctgtcacagaaaggcactgtgctgggctagcttcactttttgcagtgacacctacgtcacaagatggcatttggagaatattgtgccaagtagaataaaatgcctcacagcttaaaacagtgaatgtgagaagctgaagatttctgtcccaacaaaatgttttagaatcgggttttgtgaaatggttaacgtatttttttcagtggatataaatttaacttcttaaaagaaaatcttcctacttcataagcaccctgtatatatttgcatataaaagtgtggactgccttaaaaatagatgggccaaggaaaacaggagtggagatgatgtgactttgctccatgcactgtggaaagatatgctctgctctatacaaaaattgccatggttctctgctgcatgtgaaaaagatcctgaactagactgtgaaccttgtacatgtttgccatccacggtggtcgagtttgatgaacactgtgccttcttattgtcactttgaagtcacccagcagcatgcagtcgatgatagtccatgcatgtccctgttctcctacacacaataacacagtgagggggacggttggctccgggacaggggacaggtgtcattgcagccctggtctcattttcatctgctctggtgatggtacacagcaggaagttagctgtttgattgctaacccaaatcactcttctgttttctctacttgactgctgacaagtttaacaaagtgtgtggctcttctccttcctgcttgggaaccaggaggggttgggacccatagttcatgatcgaaagtctcagacattgcctgtttcccgtaacagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggtgagcctcctgtccattctgcagactgtcctaagtcctttaa

SEQ ID NO: 125875 - DNA, 7549 bp, Homo sapiens
  Payload ID: 4658
  Gene Symbol: DOCK9
  Gene Name: dedicator of cytokinesis 9
  Uniprot ID: Q9BZ29
  ENST ID: ENST00000376460
  CDS Start-End: 82-6288
ctggcatgcctgtgccttgcacggccagggactcgcagctgttccagttgcagactttctgacttgcgttttcagccgagaatgcaggctgataaatgcaggacaagtagtagaagtgtcaaaaaggaactggtgattgagtcccccctgcaatacaaggatgcagctcagggcgaagtggaagcagagagcccgggccctgtgccggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcagctgggatgatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 125876 - DNA, 3147 bp, Homo sapiens
  Payload ID: 4658
  Gene Symbol: DOCK9
  Gene Name: dedicator of cytokinesis 9
  ENST ID: ENST00000400228
  CDS Start-End: 1-2008
ttttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 125877 - DNA, 1169 bp, Homo sapiens
  Payload ID: 4658
  Gene Symbol: DOCK9
  Gene Name: dedicator of cytokinesis 9
  ENST ID: ENST00000419908
  CDS Start-End: 1-1169
cccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcag

SEQ ID NO: 125878 - DNA, 348 bp, Homo sapiens
  Payload ID: 4658
  Gene Symbol: DOCK9
  Gene Name: dedicator of cytokinesis 9
  ENST ID: ENST00000450257
  CDS Start-End: 1-348
catctgaacttatggatttttttacaatatctgaagtctgcctgcaccagttccagtacatggggaagcgatacatagccaggaaccaggaggggttgggacccatagttcatgatcgaaagtctcagacattgcctgtttcccgtaacagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctgg

SEQ ID NO: 125879 - DNA, 7457 bp, Homo sapiens
  Payload ID: 4658
  Gene Symbol: DOCK9
  Gene Name: dedicator of cytokinesis 9
  ENST ID: ENST00000448493
  CDS Start-End: 56-6295
gcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 125880 - DNA, 750 bp, Homo sapiens
  Payload ID: 4658
  Gene Symbol: DOCK9
  Gene Name: dedicator of cytokinesis 9
  ENST ID: ENST00000449796
  CDS Start-End: 1-750
gctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaac

SEQ ID NO: 125881 - DNA, 7643 bp, Homo sapiens
  Payload ID: 4658
  Gene Symbol: DOCK9
  Gene Name: dedicator of cytokinesis 9
  ENST ID: ENST00000442173
  CDS Start-End: 176-6481
gtcatgccttcccaccccacaggctctgcagacccagccagcggggctgaccacttgtgcctgggaagccagtttcctttccttccttggaccactggcatgcctgtgccttgcacggccagggactcgcagctgttccagttgcagactttctgacttgcgttttcagccgagaatgcaggctgataaatgcaggacaagtagtagaagtgtcaaaaaggaactggtgattgagtcccccctgcaatacaaggatgcagctcagggcgaagtggaagcagagagcccgggccctgtgccggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattgcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagaacaggaatgatgcatgccagattgcagcagctgggcagcctggataactctctcacttttaaccacagctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaagaagcagtccagtgggagccgccccttctcccccacagccatagcgcctgcctgaggaggagccggggaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcaggcagcgcaataccagtttacagacagtgaaacagatgtggagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcaggtgagaagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctgaccatt

SEQ ID NO: 125882 - DNA, 609 bp, Homo sapiens
  Payload ID: 4658
  Gene Symbol: DOCK9
  Gene Name: dedicator of cytokinesis 9
  ENST ID: ENST00000451563
  CDS Start-End: 1-609
aggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaag

SEQ ID NO: 125883 - DNA, 4176 bp, Homo sapiens
  Payload ID: 4658
  Gene Symbol: DOCK9
  Gene Name: dedicator of cytokinesis 9
  ENST ID: ENST00000427887
  CDS Start-End: 275-4039
cgccacacgcacggtcgcccggagcgagcccgggcgctgctgcgatcgcggggggccgcggacgccgaggggggcgccttggggcgtgacacggtgcagagggcgcggcctgggctgcggcggccggactcgcggcgagcagcggggggagcaggcggcggcggcgccgggagcggcgggcggagcgggccgggcgccgagggcgcacctggcggccgcgcggccgggccgggccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattggtaacgctccatgctcttgtgggcttctctccaccatcactctgaaagtgtcttggagccaatagttggtgaacgtgtcacacttgtgtggtaggaccttgaagtctaagttgctttcctgagtattcttttcctgcttgtgatagtcaacaactgaaacccctcagccatgccctgaaataaaggtcccggatgcctgtga

SEQ ID NO: 125884 - DNA, 420 bp, Homo sapiens
  Payload ID: 4658
  Gene Symbol: DOCK9
  Gene Name: dedicator of cytokinesis 9
  ENST ID: ENST00000479769
  CDS Start-End: 43-252
gccgcgggagcaggcggaggcggaggcggcgggggcaggaggatgtcgcagccgccgctgctccccgcctcggcggagactcggaagttcacccgggcgctgagtaagccgggcacggcggccgagctgcggcagagcgtgtctgaggtggtgcgcggctccgtgctcctggcagcaggtgagccactcccagttgatcccttttccctggagtcagtcatgtgtcccggaagtgcttccagcagctgctgaagacctctgccctatgaggtcactaggagttctttcattaagtgacctgaggcaaagccaaagctaattgagccactcgactatgaaaatgtcatcgtccagaagaagactcagatcctgaacgactgtttacgggagatgctgctcttcccttacgatgactttcag

SEQ ID NO: 125885 - DNA, 11831 bp, Homo sapiens
  Payload ID: 4658
  Gene Symbol: DOCK9
  Gene Name: dedicator of cytokinesis 9
  ENST ID: ENST00000630992
  CDS Start-End: 153-2270
ctctgcagacccagccagcggggctgaccacttgtgcctgggaagccagtttcctttccttccttggaccactggcatgcctgtgccttgcacggccagggactcgcagctgttccagttgcagactttctgacttgcgttttcagccgagaatgcaggctgataaatgcaggacaagtagtagaagtgtcaaaaaggaactggtgattgagtcccccctgcaatacaaggatgcagctcagggcgaagtggaagcagagagcccgggccctgtgccggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattggtaacgctccatgctcttgtgggcttctctccaccatcactctgaaagtgtcttggagccaatagttggtgaacgtgtcacacttgtgtggtaggaccttgaagtctaagttgctttcctgagtattcttttcctgcttgtgatagtcaacaactgaaacccctcagccatgccctgaaataaaggtcccggatgcctgtgactcctcaggatcatacagttaatcactggctcacgctgtttgctttttgttcaacgtttgttgagttttcattttaaatcttaattggattgtgtatactgttaagggatatttttgcaggtggtggggggaggggaacactgatttgtagtgttagcaattttgatgaaatatgacatagtaattccagaagaacgtagcagtttgtggctagaattcagtgctaaaatcagttctcaaaagtcttctgtcccgcaagactttttctgtgtgaaataacagaagagcggccacctctgagagaaaaacacgtgacacaaatcaagattctaatagtttctccataagaaaatgccggacataatgtacttattaatattctgactaaatgaacgcctgtgctagcttttcctcagagatagcagtttacatatatatatatatatatacacacacacacacacacacacacaaacacacatatcctccaagaattgtcacaggtgctcacagccttcttcagtctttatttctccctgtctttatcacattttgaataaagaaagcatcctactatggctagtggctagactacctaataatgggactaattcatgggataaaataaatggcagcctttatccaattaactcacaggacttgcccactctgagattatgtctttacctttgccggtggtggtggtggtaatacgccatttcatgtaggggatgaaactgggtagaatttaacatgagaaaccccacaccaatgcccaaatttatcctgcaataataataccagtccttaacctggttgatatttatgtgtctttttcacagttatgctctccttagttgacactgtaaagattaaaagagttaattcatgcaaaatgcttgcaacagagcctggcacacggtaaatgctcagcaaatgttggctgctgtcacgagtttccatttgcctttcttctgggccttcactctgtctctgccctgctttgccccattcccagccactgctccagaagcagggaggggaccttccttagagggttttgtctgcagtggttcacagcactagctttaaagtcagacagatgcagccttggatctggaatcgaccatttactagttaccatggcaggatgttgtctatcttctttgccctccatacccatgtcttcaaaacggtcgttagagggattaagagctgatacaaagtgtatggtggttggcagagaggagtcagatgagtggaaacatcacttcactgtaaccttgatcatttccacaaagttttaatacttctgtttgactcttttgactcttctccaattcagaattcaccttgttaggattggggacttctttagaacttggagataggccactggggatctttagcatcatagcctccaattgctccgcactgacattgcagctgtgaaaagtacttgaaactgacttaatcctttttcactcttgaattttaagatccaaatccacttttcataggaattcacctcgacaggcttattatactcaggttatctatattgcctcctttcttgaagatttaaatccctgttctcttttaggagtaccttccagggaagcctcatctttgaactgggtttactagtttttttctggcagctttaacaattctttgttcatcagggagtttctagctaattttagtcctggtgcttctccttcaagagcaaactctccttacatctctgttagaagaatcctgtttccacacatactgagaatgtgccgtcacagttttttaaatgtctttggatcatggtgcctgagagttttaaaagtgattcactgcctggataaaaactactctgagattacattcattttaaaaggcaagcgtcctgaggctcagggtttctttttccacctactcagtggtaccaagggaagagggacgaatttatcttcttttcattttactcaagtgtcgtttaaggactttaaaagctatgcactgggccaggatattaaatacaaacacatacacaaagacataaaaataggaacaaactaagcatattgattttgatatattgcatttccatctgtttgtcttaaattaggactctagttctggaatcaagcttgagactctgagaacttagggcctaattttactttactgaggacctctttctcttgagttctgtgttctttttcatgacttctgtgttcttcaaatgctgttctacattaaatatgaaatatgattatattagaaaaattataatttggtcatagcatgtgtttcttatctgagtacagaaaaaggccatagttttttcacagggtttttacctgtcccttgcgacaatcattcacatggtttctctcctggggagacgcagccactggctgacaataaggcttaatgaaaccatgttcaagcctttgcttcttttttcaaattctcctggctcttcttttcttgatctttaatacactgaatcagtttcagggatagcagtgaataaatctgagtgttcaacagagggaaggatttatgaccttgatgtcacaggtcttccttctaaggttaaagagttaaagactgaccaggcacggtggctcatgcctgtaatcccagcactttgggaggccgaggtgggcagatcacctgaggtcaggagttcgacaccagcctggccaacatggtgaaaacccgtctctactagaaatacaaaaaaattagccagggttggtggcagtcgcctgtaatcacagctacttgggaggctgaggcagaggagtcactttcaaatatacttttggtgtaacctagaggctggctatatttattttgttgtttatttattttttaacttagaagtatcccagtccatggcagctcatttgcctactgagatctgaaaacaaccagcctgttgtgaagtgccaagtaatggcatcttcagcttgcgtctgggagaatgtgtgctcacagctgccagacacagagtccaaatctcctgatgccatctgccaaaccagccaggcctttccgctggaggcacgccttttggttcagcacggaatgtacaagtccaaagagtcgttttaaattatgtgatttatttaaatcttatctaagcaggaagtcaatctattaccttaaaaaattccatagtaccaagatagggagtgatttctgccttcaaatactgtttttttcatggacatcacaaattttatttccacattagatttcctttctgctcatagttgtttatagcagattcccagatattccccgttcacagcacccttagtgtcactttatttcgtggcatccctaggctgaaagacacacccagcagttctctttattaggtacttaggaccaaataacttaataagtacttacatcctaacaatttagtaggcacttaaaagaaataatacacataaatttaaaggaaacaattaattttatttttaataaccacaactcactacaaatgggtggtgtgtacctgttggacactgacagcttctcagcctttgggtcagattggccagcaccattcgcatttcctgtccctcattgattacttgccttttatcatagcaggcccccaaatacccagcttcacaaatatgtcttcaaaaggagcatagcacaacctgctgctgaaacagcagcttctggctgaggtcacatatcactgtgttctcctcgaaaatttaaaataccccatgacacccctcagagttgggtaggctcctcagtgtttattaccagtttgaatgctacaagtttgttgtgtggtttaattttgtgatttgatagttgtaggtggatttatcttttaatttttttaagtcttcattctatcacattctgaaacaggtatgcatttagtctttagcgatcaaaggtggtttctaacaagtgaattgatgtttacatctgaatgtttcagactagtttctttttatctcattgtatatgacctggttctttaaaggtgaagtaatggaatgcaactcttgagccaacttcctaacagaaaaaataagtgcaataaaagcaatttcccttaaagttcagtactcatctttattttgttctgtcttaataaaactttattgttggcttgatttccatttagcttctccatatacaacctcaactccaaacatcaacagtgtgagaaatgctgattcgagaggatctctcataagcacagattcgggtaacagccttccagaaaggaatagtgagaagagcaattccctggataagcaccaacaaagtagcacattgggaaattccgtggttcgctgtgataaacttgaccagtctgagattaagagcctactgatgtgtttcctctacatcttaaagagcatgtctgatgatgctttgtttacatattggaacaaggcttcaacatctgaacttatggatttttttacaatatctgaagtctgcctgcaccagttccagtacatggggaagcgatacatagccagtgtgagaaagatatcaagtgtgcttggaatttctgtagacaatggctatggccactcggacgcagatgttctgcaccagtcattacttgaagccaacattgctactgaggtttgcctgacagctctggacacgctttctctatttacattggcgtttaagaaccagctcctggccgaccatggacataatcctctcatgaaaaaagtttttgatgtctacctgtgttttcttcaaaaacatcagtctgaaacggctttaaaaaatgtcttcactgccttaaggtccttaatttataagtttccctcaacattctatgaagggagagcggacatgtgtgcggctctgtgttacgagattctcaagtgctgtaactccaagctgagctccatcaggacggaggcctcccagctgctctacttcctgatgaggaacaactttgattacactggaaagaagtcctttgtccggacacatttgcaagtcatcatatctgtcagccagctgatagcagacgttgttggcattgggggaaccagattccagcagtccctgtccatcatcaacaactgtgccaacagtgaccggcttattaagcacaccagcttctcctctgatgtgaaggacttaaccaaaaggatacgcacggtgctaatggccaccgcccagatgaaggagcatgagaacgacccagagatgctggtggacctccagtacagcctggccaaatcctatgccagcacgcccgagctcaggaagacgtggctcgacagcatggccaggatccatgtcaaaaatggcgatctctcagaggcagcaatgtgctatgtccacgtaacagccctagtggcagaatatctcacacggaaaggcgtgtttagacaaggatgcaccgccttcagggtcattaccccaaacatcgacgaggaggcctccatgatggaagacgtggggatgcaggatgtccatttcaacgaggatgtgctgatggagctccttgagcagtgcgcagatggactctggaaagccgagcgctacgagctcatcgccgacatctacaaacttatcatccccatttatgagaagcggagggattttgagaggctggcccatctgtatgacacgctgcaccgggcctacagcaaagtgaccgaggtcatgcactcgggccgcaggcttctggggacctacttccgggtagccttcttcgggcagggattctttgaagatgaagatggaaaggagtatatttacaaggaacccaaactcacaccgctgtcggaaatttctcagagactccttaaactgtactcggataaatttggttctgaaaatgtcaaaatgatacaggattctggcaaggtcaaccctaaggatctggattctaagtatgcatacatccaggtgactcacgtcatccccttctttgacgaaaaagagttgcaagaaaggaaaacagagtttgagagatcccacaacatccgccgcttcatgtttgagatgccatttacgcagaccgggaagaggcagggcggggtggaagagcagtgcaaacggcgcaccatcctgacagccatacactgcttcccttatgtgaagaagcgcatccctgtcatgtaccagcaccacactgacctgaaccccatcgaggtggccattgacgagatgagtaagaaggtggcggagctccggcagctgtgctcctcggccgaggtggacatgatcaaactgcagctcaaactccagggcagcgtgagtgttcaggtcaatgctggcccactagcatatgcgcgagctttcttagatgatacaaacacaaagcgatatcctgacaataaagtgaagctgcttaaggaagttttcaggcaatttgtggaagcttgcggtcaagccttagcggtaaacgaacgtctgattaaagaagaccagctcgagtatcaggaagaaatgaaagccaactacagggaaatggcgaaggagctttctgaaatcatgcatgagcagatctgccccctggaggagaagacgagcgtcttaccgaattcccttcacatcttcaacgccatcagtgggactccaacaagcacaatggttcacgggatgaccagctcgtcttcggtcgtgtgattacatctcatggcccgtgtgtggggacttgctttgtcatttgcaaactcaggatgctttccaaagccaatcactggggagaccgagcacagggaggaccaaggggaaggggagagaaaggaaataaagaacaacgttatttcttaacagactttctataggagttgtaagaaggtgcacatatttttttaaatctcactggcaatattcaaagttttcattgtgtcttaacaaaggtgtggtagacactcttgagctggacttagattttattcttccttgcagagtagtgttagaatagatggcctacagaaaaaaaaggttctgggatctacatggcagggagggctgcactgacattgatgcctgggggaccttttgcctcgaggctgagctggaaaatcttgaaaatattttttttttcctgtggcacattcaggttgaatacaagaactatttttgtgactagtttttgatgacctaagggaactgaccattgtaatttttgtaccagtgaaccaggagatttagtgcttttatattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggtggtgtactttaaagctgtcaccatgttatattttcttttaagactttaatttagtaattttatatttgggaaaataaaggtttttaattttatttaactggaatcactgccctgctgtaattaaacattctgtaccacatctgtattaaaaagacattgctga

SEQ ID NO: 125886 - DNA, 4096 bp, Homo sapiens
  Payload ID: 4658
  Gene Symbol: DOCK9
  Gene Name: dedicator of cytokinesis 9
  Uniprot ID: Q9BZ29
  ENST ID: ENST00000627024
  CDS Start-End: 176-3937
gtcatgccttcccaccccacaggctctgcagacccagccagcggggctgaccacttgtgcctgggaagccagtttcctttccttccttggaccactggcatgcctgtgccttgcacggccagggactcgcagctgttccagttgcagactttctgacttgcgttttcagccgagaatgcaggctgataaatgcaggacaagtagtagaagtgtcaaaaaggaactggtgattgagtcccccctgcaatacaaggatgcagctcagggcgaagtggaagcagagagcccgggccctgtgccggcaaagccaaagctaattgagccactcgactatgaaaatgtcatcgtccagaagaagactcagatcctgaacgactgtttacgggagatgctgctcttcccttacgatgactttcagacggccatcctgagacgacagggtcgatacatatgctcaacagtgcctgcgaaggcggaagaggaagcacagagcttgtttgttacagagtgcatcaaaacctataactctgactggcatcttgtgaactataaatatgaagattactcaggagagtttcgacagcttccgaacaaagtggtcaagttggataaacttccagttcatgtctatgaagttgacgaggaggtcgacaaagatgaggatgctgcctcccttggttcccagaagggtgggatcaccaagcatggctggctgtacaaaggcaacatgaacagtgccatcagcgtgaccatgaggtcatttaagagacgatttttccacctgattcaacttggcgatggatcctataatttgaatttttataaagatgaaaagatctccaaagaaccaaaaggatcaatatttctggattcctgtatgggtgtcgttcagaacaacaaagtcaggcgttttgcttttgagctcaagatgcaggacaaaagtagttatctcttggcagcagacagtgaagtggaaatggaagaatggatcacaattctaaataagatcctccagctcaactttgaagctgcaatgcaagaaaagcgaaatggcgactctcacgaagatgatgaacaaagcaaattggaaggttctggttccggtttagatagctacctgccggaacttgccaagagtgcaagagaagcagaaatcaaactgaaaagtgaaagcagagtcaaacttttttatttggacccagatgcccagaagcttgacttctcatcagctgagccagaagtgaagtcatttgaagagaagtttggaaaaaggatccttgtcaagtgcaatgatttatctttcaatttgcaatgctgtgttgccgaaaatgaagaaggacccactacaaatgttgaacctttctttgttactctatccctgtttgacataaaatacaaccggaagatttctgccgatttccacgtagacctgaaccatttctcagtgaggcaaatgctcgccaccacgtccccggcgctgatgaatggcagtgggcagagcccatctgtcctcaagggcatccttcatgaagccgccatgcagtatccgaagcagggaatattttcagtcacttgtcctcatccagatatatttcttgtggccagaattgaaaaagtccttcaggggagcatcacacattgcgctgagccatatatgaaaagttcagactcttctaaggtggcccagaaggtgctgaagaatgccaagcaggcatgccaaagactaggacagtatagaatgccatttgcttgggcagcaaggacattgtttaaggatgcatctggaaatcttgacaaaaatgccagattttctgccatctacaggcaagacagcaataagctatccaatgatgacatgctcaagttacttgcagactttcggaaacctgagaagatggctaagctcccagtgattttaggcaatctagacattacaattgataatgtttcctcagacttccctaattatgttaattcatcatacattcccacaaaacaatttgaaacctgcagtaaaactcccatcacgtttgaagtggaggaatttgtgccctgcataccaaaacacactcagccttacaccatctacaccaatcacctttacgtttatcctaagtacttgaaatacgacagtcagaagtcttttgccaaggctagaaatattgcgatttgcattgaattcaaagattcagatgaggaagactctcagccccttaagtgcatttatggcagacctggtgggccagttttcacaagaagcgcctttgctgcagttttacaccatcaccaaaacccagaattttatgatgagattaaaatagagttgcccactcagctgcatgaaaagcaccacctgttgctcacattcttccatgtcagctgtgacaactcaagtaaaggaagcacgaagaagagggatgtcgttgaaacccaagttggctactcctggcttcccctcctgaaagacggaagggtggtgacaagcgagcagcacatcccggtctcggcgaaccttccttcgggctatcttggctaccaggagcttgggatgggcaggcattatggtccggaaattaaatgggtagatggaggcaagccactgctgaaaatttccactcatctggtttctacagtgtatactcaggatcagcatttacataattttttccagtactgtcagaaaaccgaatctggagcccaagccttaggaaacgaacttgtaaagtaccttaagagtctgcatgcgatggaaggccacgtgatgatcgccttcttgcccactatcctaaaccagctgttccgagtcctcaccagagccacacaggaagaagtcgcggttaacgtgactcgggtcattattcatgtggttgcccagtgccatgaggaaggattggagagccacttgaggtcatatgttaagtacgcgtataaggctgagccatatgttgcctctgaatacaagacagtgcatgaagaactgaccaaatccatgaccacgattctcaagccttctgccgatttcctcaccagcaacaaactactgaagtactcatggtttttctttgatgtactgatcaaatctatggctcagcatttgatagagaactccaaagttaagttgctgcgaaaccagagatttcctgcatcctatcatcatgcagtggaaaccgttgtaaatatgctgatgccacacatcactcagaagtttcgagataatccagaggcatctaagaacgcgaatcatagccttgctgtcttcatcaagagatgtttcaccttcatggacaggggctttgtcttcaagcagatcaacaactacattagctgttttgctcctggagacccaaagaccctctttgaatacaagtttgaatttctccgtgtagtgtgcaaccatgaacattatattccgttgaacttaccaatgccatttggaaaaggcaggattcaaagataccaagacctccagcttgactactcattaacagatgagttctgcagaaaccacttcttggtgggactgttactgagggaggtggggacagccctccaggagttccgggaggtccgtctgatcgccatcagtgtgctcaagaacctgctgataaagcattcttttgatgacagatatgcttcaaggagccatcaggcaaggatagccaccctctacctgcctctgtttggtctgctgattgaaaacgtccagcggatcaatgtgagggatgtgtcacccttccctgtgaacgcgggcatgactgtgaaggatgaatccctggctctaccagctgtgaatccgctggtgacgccgcagaagggaagcaccctggacaacagcctgcacaaggacctgctgggcgccatctccggcattggtaacgctccatgctcttgtgggcttctctccaccatcactctgaaagtgtcttggagccaatagttggtgaacgtgtcacacttgtgtggtaggaccttgaagtctaagttgctttcctgagtattcttttcctgcttgtgatagtcaacaactgaaacccctcagccatgccctgaaataaaggtcccggatgcctgtgactcctcaggatcatacagttaa

SEQ ID NO: 125887 - DNA, 2267 bp, Homo sapiens
  Payload ID: 4659
  Gene Symbol: DET1
  Gene Name: de-etiolated homolog 1 (Arabidopsis)
  Uniprot ID: Q7L5Y6
  ENST ID: ENST00000268148
  CDS Start-End: 147-1799
ggtggctggcggaaacgggaacgtgcagccgcgggtgcaggagtcctggggcatggcgggggcggggcagggggaggcgcgcacagaacaggctggggcatccctcgccctggctctttgagcccggaccagacagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 125888 - DNA, 2154 bp, Homo sapiens
  Payload ID: 4659
  Gene Symbol: DET1
  Gene Name: de-etiolated homolog 1 (Arabidopsis)
  Uniprot ID: Q7L5Y6
  ENST ID: ENST00000444300
  CDS Start-End: 1-1686
atggtgggacagatactaaaaagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 125889 - DNA, 1925 bp, Homo sapiens
  Payload ID: 4659
  Gene Symbol: DET1
  Gene Name: de-etiolated homolog 1 (Arabidopsis)
  ENST ID: ENST00000557837
  CDS Start-End: 132-335
cgggaacgtgcagccgcgggtgcaggagtcctggggcatggcgggggcggggcagggggaggcgcgcacagaacaggctggggcatccctcgccctggctctttgagcccggaccagacagagatgtgataatggatcatcatgtttctaccatcaagcctcgaagaatccaaaaccaaaatgtcattcaccgcttggaacgccggcggatcagttcaggcaagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 125890 - DNA, 2258 bp, Homo sapiens
  Payload ID: 4659
  Gene Symbol: DET1
  Gene Name: de-etiolated homolog 1 (Arabidopsis)
  ENST ID: ENST00000557842
  CDS Start-End: 117-320
gcgggtgcaggagtcctggggcatggcgggggcggggcagggggaggcgcgcacagaacaggctggggcatccctcgccctggctctttgagcccggaccagacagagatgtgataatggatcatcatgtttctaccatcaagcctcgaagaatccaaaaccaaaatgtcattcaccgcttggaacgccggcggatcagttcaggcaagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatacttaaatatatgtggttggatgactgctttatgttcctatcatactcaatgctttcaagtacttgggttccaggaaggactgtgaaagagatgagaggccatggatgcagcagctgttcctgggagaactaagtgggacagtggagacagatgaaggaagggc

SEQ ID NO: 125891 - DNA, 583 bp, Homo sapiens
  Payload ID: 4659
  Gene Symbol: DET1
  Gene Name: de-etiolated homolog 1 (Arabidopsis)
  ENST ID: ENST00000558413
  CDS Start-End: 106-390
agtcctggggcatggcgggggcggggcagggggaggcgcgcacagaacaggctggggcatccctcgccctggctctttgagcccggaccagacagagatgtgataatggatcatcatgtttctaccatcaagcctcgaagaatccaaaaccaaaatgtcattcaccgcttggaacgccggcggatcagttcaggcaaggcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggt

SEQ ID NO: 125892 - DNA, 2315 bp, Homo sapiens
  Payload ID: 4659
  Gene Symbol: DET1
  Gene Name: de-etiolated homolog 1 (Arabidopsis)
  Uniprot ID: Q7L5Y6
  ENST ID: ENST00000564406
  CDS Start-End: 162-1847
gtgcagccgcgggtgcaggagtcctggggcatggcgggggcggggcagggggaggcgcgcacagaacaggctggggcatccctcgccctggctctttgagcccggaccagacaggtgctgggaatacagcaaggaattagaccagttccctgctctctggtatggtgggacagatactaaaaagagatgtgataatggatcatcatgtttctaccatcaagcctcgaagaatccaaaaccaaaatgtcattcaccgcttggaacgccggcggatcagttcaggcaaggcaggtacccactggcaccaagtccgagtgttccatcagaatgtcttccccaacttcacagttgtcaacgttgaaaagcctccttgtttcttgcgtaaattctcacctgatggacgctactttattgctttttcttcagaccagacatctcttgaaatctatgagtaccagggctgccaggcagcagaggacctactgcagggatacgaaggagaaatcctgtccaatggcaatgaccagcggtcagtgaatatccggggccggctctttgaacgcttttttgtcctgctgcacattaccaatgttgcggccaatggtgagcacctgaaccgggagtgtagtctcttcactgatgactgccgctgtgtcatcgtgggctcagctgcctacctcccagatgagcctcaccctccattttttgaggtatatcggaacagtgaatcagtgacccccaacccacggtcccctctagaagactattccctccatatcattgaccttcacaccggccgcttatgtgatacacgcacgttcaagtgtgacaaggtggtcttgtcacacaaccaagggctgtacttgtacaaaaacatcctggccatcttgtctgtgcaacaacagaccatccatgtcttccaggtgactcctgaaggcactttcattgatgtgcggaccattggccgcttttgctatgaggatgacctgctcactgtgtcagctgttttccctgaggtacagcgggacagtcagacaggcatggccaatccctttagggatcctttcatcaattccctcaaacaccggttgctggtatatttgtggcgccgggcagaacaggatggtagtgcaatggccaagaggcgcttcttccagtattttgaccaactgcggcagctgcgaatgtggaaaatgcagcttctggatgaaaaccacctgtttatcaagtacactagtgaggatgtagtaacactgcgagtcacagatccatcacaggcatctttctttgtggtgtacaatatggtgacgacagaggtgattgctgtgtttgagaatacatcagatgagcttttggagctctttgagaacttctgtgacctttttcgtaatgctaccctgcacagtgaagttcagtttccctgctcagcttctagcaacaattttgcaaggcagatccagcgccggttcaaagacactattataaatgccaagtatggagggcacacagaggcagtacgccggctgctgggtcagctccccatcagtgctcagtcttacagcggtagcccctatctggatttgtctctcttcagttatgatgacaagtgggtatctgtcatggagcggcccaagacttgtggagatcacccaatcaggttctatgcccgggactcgggcctgctcaagtttgagatccaggcggggttattgggccgccccatcaaccacacagtgcgacgccttgttgccttcacctttcacccttttgagcctttcgctatttctgtgcagaggactaatgctgagtatgttgtcaacttccatatgcgacactgctgcacgtaggtgcctcaccagagccagattatctggtcttccaagactttgccactcacttatctcagtggactccaaagcaaaagctcccgactactagctctgttagttccagcctgctatacctcagatgggagagagccagagagaggagtgagggtggctcaacctaatggaatttttaaattgtatacaatactgctactgattgttataatatcctcttgcgttttccctgtgggaatgcccagcattaattaagtccatttcatttttgctttactttgcatttgattgctgtgaagatgaaagcattagacttttatccccttcatgtcacttcttcggcattatggtttgcatctgaaagcagttaaatcttgtttactgatgagaatgacatacatcctttccatttagctcataagcacggctatctttttaagagaaaaataaagccatggtattttcatactt

SEQ ID NO: 125893 - DNA, 2262 bp, Homo sapiens
  Payload ID: 4660
  Gene Symbol: DEF6
  Gene Name: DEF6 guanine nucleotide exchange factor
  Uniprot ID: Q9H4E7
  ENST ID: ENST00000316637
  CDS Start-End: 6-1901
cagccatggccctgcgcaaggaactgctcaagtccatctggtacgcctttaccgcgctggacgtggagaagagtggcaaagtctccaagtcccagctcaaggtgctgtcccacaacctgtacacggtcctgcacatcccccatgaccccgtggccctggaggaacacttccgagatgatgatgacggccctgtgtccagccagggatacatgccctacctcaacaagtacatcctggacaaggtggaggagggggcttttgttaaagagcactttgatgagctgtgctggacgctgacggccaagaagaactatcgggcagatagcaacgggaacagtatgctctccaatcaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcagggctacctgtggaagcgagggcacctgagaaggaactgggccgaacgctggttccagctgcagcccagctgcctctgctactttgggagtgaagagtgcaaagagaaaaggggcattatcccgctggatgcacactgctgcgtggaggtgctgccagaccgcgacggaaagcgctgcatgttctgtgtgaagacagccaaccgcacgtatgagatgagcgcctcagacacgcgccagcgccaggagtggacagctgccatccagatggcgatccggctgcaggccgaggggaagacgtccctacacaaggacctgaagcagaaacggcgcgagcagcgggagcagcgggagcggcgccgggcggccaaggaagaggagctgctgcggctgcagcagctgcaggaggagaaggagcggaagctgcaggagctggagctgctgcaggaggcgcagcggcaggccgagcggctgctgcaggaggaggaggaacggcgccgcagccagcaccgcgagctgcagcaggcgctcgagggccaactgcgcgaggcggagcaggcccgggcctccatgcaggctgagatggagctgaaggaggaggaggctgcccggcagcggcagcgcatcaaggagctggaggagatgcagcagcggttgcaggaggccctgcaactagaggtgaaagctcggcgagatgaagaatctgtgcgaatcgctcagaccagactgctggaagaggaggaagagaagctgaagcagttgatgcagctgaaggaggagcaggagcgctacatcgaacgggcgcagcaggagaaggaagagctgcagcaggagatggcacagcagagccgctccctgcagcaggcccagcagcagctggaggaggtgcggcagaaccggcagagggctgacgaggatgtggaggctgcccagagaaaactgcgccaggccagcaccaacgtgaaacactggaatgtccagatgaaccggctgatgcatccaattgagcctggagataagcgtccggtcaccagcagctccttctcaggcttccagccccctctgcttgcccaccgtgactcctccctaaagcgcctgacccgctggggatcccagggcaacaggaccccctcgcccaacagcaatgagcagcagaagtccctcaatggtggggatgaggctcctgccccggcttccacccctcaggaagataaactggatccagcaccagaaaattagcctctcttagccccttgttcttcccaatgtcatatccaccaggacctggccacagctggcctgtgggtgatcccagctcttactaggagagggagctgaggtcctggtgccaggggcccaggccctccaaccataaacagtccaggatggaacctggttcacccttcataccagctccaagccccagaccatgggagctgtctgggatgttgatccttgagaacttggccctgtgctttagacccaaggacccgattcttgggctaggaaagagagaacaagcaagccggggctacctgcccccaggtggccaccaagttgtggaagcacatttctaaataaaaactgctcttagaatgaa

SEQ ID NO: 125894 - DNA, 385 bp, Homo sapiens
  Payload ID: 4660
  Gene Symbol: DEF6
  Gene Name: DEF6 guanine nucleotide exchange factor
  ENST ID: ENST00000444278
  CDS Start-End: 1-385
ccgagatgatgatgacggccctgtgtccagccagggatacatgccctacctcaacaagtacatcctggacaaggatgccttccgcctctggtgcctcttcaacttcctgtctgaggacaagtaccctctgatcatggttcctgatgaggtggaatacctgctgaaaaaggtactcagcagcatgagcttggaggtgagcttgggtgagctggaggagcttctggcccaggaggcccaggtggcccagaccaccggggggctcagcgtctggcagttcctggagctcttcaattcgggccgctgcctgcggggcgtgggccgggacaccctcagcatggccatccacgaggtctaccaggagctcatccaagatgtcctgaagcag

SEQ ID NO: 125895 - DNA, 731 bp, Homo sapiens
  Payload ID: 4661
  Gene Symbol: DAD1
  Gene Name: defender against cell death 1
  Uniprot ID: P61803
  ENST ID: ENST00000250498
  CDS Start-End: 113-454
ggggagggcggagttaggtcacgagggtgcgcatgcgcaaacagcacatccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctcca

SEQ ID NO: 125896 - DNA, 441 bp, Homo sapiens
  Payload ID: 4661
  Gene Symbol: DAD1
  Gene Name: defender against cell death 1
  ENST ID: ENST00000538631
  CDS Start-End: 1-237
atgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcct

SEQ ID NO: 125897 - DNA, 501 bp, Homo sapiens
  Payload ID: 4661
  Gene Symbol: DAD1
  Gene Name: defender against cell death 1
  ENST ID: ENST00000543337
  CDS Start-End: 66-323
atccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcgtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtc

SEQ ID NO: 125898 - DNA, 591 bp, Homo sapiens
  Payload ID: 4661
  Gene Symbol: DAD1
  Gene Name: defender against cell death 1
  ENST ID: ENST00000535847
  CDS Start-End: 64-261
ccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcatttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctc

SEQ ID NO: 125899 - DNA, 406 bp, Homo sapiens
  Payload ID: 4662
  Gene Symbol: DEFA1
  Gene Name: defensin, alpha 1
  Uniprot ID: P59665
  ENST ID: ENST00000382679
  CDS Start-End: 1-285
atgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaaga

SEQ ID NO: 125900 - DNA, 485 bp, Homo sapiens
  Payload ID: 4662
  Gene Symbol: DEFA1
  Gene Name: defensin, alpha 1
  Uniprot ID: P59665
  ENST ID: ENST00000382692
  CDS Start-End: 81-365
ctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaag

SEQ ID NO: 125901 - DNA, 491 bp, Homo sapiens
  Payload ID: 4663
  Gene Symbol: DEFA1B
  Gene Name: defensin, alpha 1B
  Uniprot ID: P59665
  ENST ID: ENST00000382689
  CDS Start-End: 86-370
ccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaaga

SEQ ID NO: 125902 - DNA, 485 bp, Homo sapiens; identical to SEQ ID NO: 125900
  Payload ID: 4663
  Gene Symbol: DEFA1B
  Gene Name: defensin, alpha 1B
  Uniprot ID: P59665
  ENST ID: ENST00000535841
  CDS Start-End: 81-365

SEQ ID NO: 125903 - DNA, 498 bp, Homo sapiens
  Payload ID: 4664
  Gene Symbol: DEFA3
  Gene Name: defensin, alpha 3, neutrophil-specific
  Uniprot ID: P59666
  ENST ID: ENST00000327857
  CDS Start-End: 93-377
ggctgctccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatctcaaataaatgccttgttacaaga

SEQ ID NO: 125904 - DNA, 385 bp, Homo sapiens
  Payload ID: 4664
  Gene Symbol: DEFA3
  Gene Name: defensin, alpha 3, neutrophil-specific
  ENST ID: ENST00000616150
  CDS Start-End: 51-335
tctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagg

SEQ ID NO: 125905 - DNA, 617 bp, Homo sapiens
  Payload ID: 4665
  Gene Symbol: DEFA4
  Gene Name: defensin, alpha 4, corticostatin
  Uniprot ID: P12838
  ENST ID: ENST00000297435
  CDS Start-End: 126-419
ccttaaataaggaagtcctctcctctgtgtgcatggctgctcttgctacataagacctggaacacaggactgctgtctgccctctctgctcgccctgcctagcttgaggatctgtcaccccagccatgaggattatcgccctcctcgctgctattctcttggtagccctccaggtccgggcaggcccactccaggcaagaggtgatgaggctccaggccaggagcagcgtgggccagaagaccaggacatatctatttcctttgcatgggataaaagctctgctcttcaggtttcaggctcaacaaggggcatggtctgctcttgcagattagtattctgccggcgaacagaacttcgtgttgggaactgcctcattggtggtgtgagtttcacatactgctgcacgcgtgtcgattaacgttctgctgtccaagagaatgtcatgctgggaacgccatcatcggtggtgttagcttcacatgcttctgcagctgagcttgcagaatagagaaaaatgagctcataatttgctttgagagctacaggaaatggttgtttctcctatactttgtccttaacatctttcttgatcctaaatatatatctcgtaacaaga

SEQ ID NO: 125906 - DNA, 449 bp, Homo sapiens
  Payload ID: 4666
  Gene Symbol: DEFA5
  Gene Name: defensin, alpha 5, Paneth cell-specific
  Uniprot ID: Q01523
  ENST ID: ENST00000330590
  CDS Start-End: 38-322
tccactcctgctctccctcctgcaggtgaccccagccatgaggaccatcgccatccttgctgccattctcctggtggccctgcaggcccaggctgagtcactccaggaaagagctgatgaggctacaacccagaagcagtctggggaagacaaccaggaccttgctatctcctttgcaggaaatggactctctgctcttagaacctcaggttctcaggcaagagccacctgctattgccgaaccggccgttgtgctacccgtgagtccctctccggggtgtgtgaaatcagtggccgcctctacagactctgctgtcgctgagcttcctagatagaaaccaaagcagtgcaagattcagttcaaggtcctgaaaaaagaaaaacattttactctgtgtaccttgtgtctttctaaatttctctctccaaaataaagttcaagcattaaa

SEQ ID NO: 125907 - DNA, 469 bp, Homo sapiens
  Payload ID: 4667
  Gene Symbol: DEFA6
  Gene Name: defensin, alpha 6, Paneth cell-specific
  Uniprot ID: Q01524
  ENST ID: ENST00000297436
  CDS Start-End: 42-344
acacatctgctcctgctctctctcctccagcgaccctagccatgagaaccctcaccatcctcactgctgttctcctcgtggccctccaggccaaggctgagccactccaagctgaggatgatccactgcaggcaaaagcttatgaggctgatgcccaggagcagcgtggggcaaatgaccaggactttgccgtctcctttgcagaggatgcaagctcaagtcttagagctttgggctcaacaagggctttcacttgccattgcagaaggtcctgttattcaacagaatattcctatgggacctgcactgtcatgggtattaaccacagattctgctgcctctgagggatgagaacagagagaaatatattcataatttactttatgacctagaaggaaactgtcgtgtgtcctatacattgccatcaactttgtttcctcatctcaaataaagtcctttcagcaagttc

SEQ ID NO: 125908 - DNA, 478 bp, Homo sapiens
  Payload ID: 4668
  Gene Symbol: DEFB1
  Gene Name: defensin, beta 1
  Uniprot ID: P60022
  ENST ID: ENST00000297439
  CDS Start-End: 166-372
cttgactgtggcacctcccttcagttccgtcgacgaggttgtgcaatccaccagtcttataaatacagtgacgctccagcctctggaagcctctgtcagctcagcctccaaaggagccagcgtctccccagttcctgaaatcctgggtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtatacctcctttgggccaaaa

SEQ ID NO: 125909 - DNA, 518 bp, Homo sapiens
  Payload ID: 4669
  Gene Symbol: DEFB103A
  Gene Name: defensin, beta 103A
  Uniprot ID: P81534
  ENST ID: ENST00000314357
  CDS Start-End: 219-422
caaatccatagggagctctgccttaccattgggttcctaattaactgagtgagtgggtgtgttctgcatggtgagaggcattggaatgatgcatcagaaaacatgtcataatgtcatcactgtaatatgacaagaattgcagctgtggctggaacctttataaagtgaccaagcacaccttttcatccagtctcagcgtggggtgaagcctagcagctatgaggatccattatcttctgtttgctttgctcttcctgtttttggtgcctgttccaggtcatggaggaatcataaacacattacagaaatattattgcagagtcagaggcggccggtgtgctgtgctcagctgccttccaaaggaggaacagatcggcaagtgctcgacgcgtggccgaaaatgctgccgaagaaagaaataaaaaccctgaaacatgacgagagtgttgtaaagtgtggaaatgccttcttaaagtttataaaagtaaaatcaaattacatttttttttcaaaaaaaa

SEQ ID NO: 125910 - DNA, 518 bp, Homo sapiens; identical to SEQ ID NO: 125909
  Payload ID: 4670
  Gene Symbol: DEFB103B
  Gene Name: defensin, beta 103B
  Uniprot ID: P81534
  ENST ID: ENST00000318124
  CDS Start-End: 219-422

SEQ ID NO: 125911 - DNA, 518 bp, Homo sapiens; identical to SEQ ID NO: 125909
  Payload ID: 4670
  Gene Symbol: DEFB103B
  Gene Name: defensin, beta 103B
  Uniprot ID: P81534
  ENST ID: ENST00000613448
  CDS Start-End: 219-422

SEQ ID NO: 125912 - DNA, 281 bp, Homo sapiens
  Payload ID: 4671
  Gene Symbol: DEFB104A
  Gene Name: defensin, beta 104A
  Uniprot ID: Q8WTQ1
  ENST ID: ENST00000314265
  CDS Start-End: 15-233
gcagccccagcattatgcagagacttgtgctgctattagccatttctcttctactctatcaagatcttccagtgagaagcgaatttgaattggacagaatatgtggttatgggactgcccgttgccggaagaaatgtcgcagccaagaatacagaattggaagatgtcccaacacctatgcatgctgtttgagaaaatgggatgagagcttactgaatcgtacaaaaccctgaaacgcagtagtgctggtccctagagtcgctggaagtaggacctcagta

SEQ ID NO: 125913 - DNA, 281 bp, Homo sapiens; identical to SEQ ID NO: 125912
  Payload ID: 4672
  Gene Symbol: DEFB104B
  Gene Name: defensin, beta 104B
  Uniprot ID: Q8WTQ1
  ENST ID: ENST00000316169
  CDS Start-End: 15-233

SEQ ID NO: 125914 - DNA, 281 bp, Homo sapiens; identical to SEQ ID NO: 125912
  Payload ID: 4672
  Gene Symbol: DEFB104B
  Gene Name: defensin, beta 104B
  Uniprot ID: Q8WTQ1
  ENST ID: ENST00000616398
  CDS Start-End: 15-233

SEQ ID NO: 125915 - DNA, 330 bp, Homo sapiens
  Payload ID: 4673
  Gene Symbol: DEFB105A
  Gene Name: defensin, beta 105A
  Uniprot ID: Q8NG35
  ENST ID: ENST00000334773
  CDS Start-End: 52-288
ggtcttctcaaggaaatcccaatctctattccgaagagtcttccctaaaagatggccctgatcaggaagacattttattttctatttgctatgttcttcattttggttcaactgccatcagggtgccaggcaggacttgatttttcccaaccatttccatcaggtgagtttgctgtctgtgagtcgtgcaagcttggtcggggaaaatgcaggaaggagtgcttggagaatgagaagcccgatggaaattgcaggctgaactttctctgctgcagacagaggatctgacaaaccagaccagcacacttctggccttagaagcagacctgg

SEQ ID NO: 125916 - DNA, 331 bp, Homo sapiens
  Payload ID: 4674
  Gene Symbol: DEFB105B
  Gene Name: defensin, beta 105B
  Uniprot ID: Q8NG35
  ENST ID: ENST00000335510
  CDS Start-End: 53-289
gggtcttctcaaggaaatcccaatctctattccgaagagtcttccctaaaagatggccctgatcaggaagacattttattttctatttgctatgttcttcattttggttcaactgccatcagggtgccaggcaggacttgatttttcccaaccatttccatcaggtgagtttgctgtctgtgagtcgtgcaagcttggtcggggaaaatgcaggaaggagtgcttggagaatgagaagcccgatggaaattgcaggctgaactttctctgctgcagacagaggatctgacaaaccagaccagcacacttctggccttagaagcagacctgg

SEQ ID NO: 125917 - DNA, 331 bp, Homo sapiens; identical to SEQ ID NO: 125916
  Payload ID: 4674
  Gene Symbol: DEFB105B
  Gene Name: defensin, beta 105B
  Uniprot ID: Q8NG35
  ENST ID: ENST00000611610
  CDS Start-End: 53-289

SEQ ID NO: 125918 - DNA, 303 bp, Homo sapiens
  Payload ID: 4675
  Gene Symbol: DEFB106A
  Gene Name: defensin, beta 106A
  Uniprot ID: Q8N104
  ENST ID: ENST00000335186
  CDS Start-End: 6-203
cagtcatgaggactttcctctttctctttgccgtgctcttctttctgaccccagccaagaatgcattttttgatgagaaatgcaacaaacttaaagggacatgcaagaacaattgcgggaaaaatgaagaacttattgctctctgccagaagtctctgaaatgctgtcggaccatccagccatgtgggagcattatagattaatgcagaagatttaggtttccagagaagcatacataacctagcttctttttactcttgcctctgctgtaggcagacactttaataaaaataaatgactgtc

SEQ ID NO: 125919 - DNA, 316 bp, Homo sapiens
  Payload ID: 4676
  Gene Symbol: DEFB106B
  Gene Name: defensin, beta 106B
  Uniprot ID: Q8N104
  ENST ID: ENST00000335479
  CDS Start-End: 19-216
ctcaagacccacccagtcatgaggactttcctctttctctttgccgtgctcttctttctgaccccagccaagaatgcattttttgatgagaaatgcaacaaacttaaagggacatgcaagaacaattgcgggaaaaatgaagaacttattgctctctgccagaagtctctgaaatgctgtcggaccatccagccatgtgggagcattatagattaatgcagaagatttaggtttccagagaagcatacataacctagcttctttttactcttgcctctgctgtaggcagacactttaataaaaataaatgactgtc

SEQ ID NO: 125920 - DNA, 316 bp, Homo sapiens; identical to SEQ ID NO: 125919
  Payload ID: 4676
  Gene Symbol: DEFB106B
  Gene Name: defensin, beta 106B
  Uniprot ID: Q8N104
  ENST ID: ENST00000621252
  CDS Start-End: 19-216

SEQ ID NO: 125921 - DNA, 389 bp, Homo sapiens
  Payload ID: 4677
  Gene Symbol: DEFB107A
  Gene Name: defensin, beta 107A
  Uniprot ID: Q8IZN7
  ENST ID: ENST00000335021
  CDS Start-End: 89-301
tcagggcagtagaacatattttaatcaatgccccttgataaaagagcttgattccagctactgcacttccttcatcagctctccactgatgcctggagccatgaaaatatttgtctttattttggctgctctcattcttcttgctcaaattttccaagccaggacagcaattcatagagcactaattagtaagagaatggaaggtcactgtgaagccgaatgtcttacctttgaagtaaagattgggggctgtagagctgaattagcaccattttgctgcaaaaacagaaagaaacattaaaaactaagcaccagctgcaagaaacaaagaggtgaagattctctggctgcgatatcagtgggataaatctctctggaccatctctctt

SEQ ID NO: 125922 - DNA, 389 bp, Homo sapiens; identical to SEQ ID NO: 125921
  Payload ID: 4678
  Gene Symbol: DEFB107B
  Gene Name: defensin, beta 107B
  Uniprot ID: Q8IZN7
  ENST ID: ENST00000355602
  CDS Start-End: 89-301

SEQ ID NO: 125923 - DNA, 389 bp, Homo sapiens; identical to SEQ ID NO: 125921
  Payload ID: 4678
  Gene Symbol: DEFB107B
  Gene Name: defensin, beta 107B
  Uniprot ID: Q8IZN7
  ENST ID: ENST00000615431
  CDS Start-End: 89-301

SEQ ID NO: 125924 - DNA, 222 bp, Homo sapiens
  Payload ID: 4679
  Gene Symbol: DEFB108B
  Gene Name: defensin, beta 108B
  Uniprot ID: Q8NET1
  ENST ID: ENST00000328698
  CDS Start-End: 1-222
atgaggattgctgtcctcctcttcgccattttcttctttatgagccaagttctaccagccaggggcaaattcaaggagatctgtgaacgtccaaatggctcctgtcgggacttttgccttgaaacagaaatccatgttgggagatgtttaaatagccaaccctgctgcctgcctctggggcatcaaccaagaattgagagcactacacccaaaaaggactga

SEQ ID NO: 125925 - DNA, 384 bp, Homo sapiens
  Payload ID: 4680
  Gene Symbol: DEFB110
  Gene Name: defensin, beta 110
  Uniprot ID: Q30KQ9
  ENST ID: ENST00000371148
  CDS Start-End: 47-250
tgaaaaaggaggtctgttgccccctttttttaagaaactctctaccatgaagattcaactttttttctttattctgcacttttgggtcacaattttaccagccaaaaagaaatatcctgagtatggtagcttggacttgaggagagagtgcagaataggtaatggtcaatgtaaaaatcagtgtcatgaaaatgaaattaggattgcttactgcataagacctggaactcattgctgcttgcagcagtaacgatgacagaagaaaagagtcacaagctccaagaagagagaccagcgttattaagttttcccagcacatccttcaaggcgtgtgtgtctctataatacacaagaactaaataaaaattaatgttgaaccattca

SEQ ID NO: 125926 - DNA, 189 bp, Homo sapiens
  Payload ID: 4680
  Gene Symbol: DEFB110
  Gene Name: defensin, beta 110
  Uniprot ID: Q30KQ9
  ENST ID: ENST00000393660
  CDS Start-End: 1-189
atgaagattcaactttttttctttattctgcacttttgggtcacaattttaccagccagaagcaattttgaaccaaagtatagatttgaaagatgcgaaaaagtgagaggaatatgtaaaacgttttgtgatgatgttgagtatgattatggatactgcattaaatggagaagtcagtgctgcgtataa

SEQ ID NO: 125927 - DNA, 342 bp, Homo sapiens
  Payload ID: 4681
  Gene Symbol: DEFB112
  Gene Name: defensin, beta 112
  Uniprot ID: Q30KQ8
  ENST ID: ENST00000322246
  CDS Start-End: 1-342
atgaaattattgacaaccatatgtagactgaaacttgaaaaaatgtactcaaagacaaatacatcttccacaatatttgaaaaggcccgacatgggacagagaaaatcagcacagccagaagtgaagggcaccatatcacctttagtaggtggaagtcatgtacagcgattggaggtcgatgtaaaaatcaatgtgatgatagtgaatttaggatttcatactgtgcaagacctacaactcattgctgcgtgacagaatgtgaccctacggacccaaataattggatcccaaaggactcagtagggactcaagaatggtaccctaaagactcacgtcattga

SEQ ID NO: 125928 - DNA, 249 bp, Homo sapiens
  Payload ID: 4682
  Gene Symbol: DEFB113
  Gene Name: defensin, beta 113
  Uniprot ID: Q30KQ7
  ENST ID: ENST00000398718
  CDS Start-End: 1-249
atgaagatactttgtatttttctgacctttgtcttcactgtgtcttgtggtccatcagttccacagaaaaaaacaagagaagttgcagagagaaaaagagaatgtcagcttgttcgtggtgcttgcaagccggaatgcaacagctgggaatatgtatattattactgcaatgttaacccctgctgtgcggtatgggaataccaaaagccaatcattaacaaaatcactagtaaactccatcaaaaataa

SEQ ID NO: 125929 - DNA, 253 bp, Homo sapiens
  Payload ID: 4683
  Gene Symbol: DEFB114
  Gene Name: defensin, beta 114
  Uniprot ID: Q30KQ6
  ENST ID: ENST00000322066
  CDS Start-End: 1-210
atgaggatcttttactatctccattttctgtgttatgtgaccttcattctaccagccacatgtaccttggtgaatgctgatcgttgcaccaaacgttacggtcgttgtaaaagagactgtcttgagagtgaaaagcaaatagacatatgttccttaccaagaaaaatttgctgcactgagaaattgtatgaagaagatgatatgttttgaaaagaaaggcatacctctgaacaaagaagttacatgtgcacca

SEQ ID NO: 125930 - DNA, 267 bp, Homo sapiens
  Payload ID: 4684
  Gene Symbol: DEFB115
  Gene Name: defensin, beta 115
  Uniprot ID: Q30KQ5
  ENST ID: ENST00000400552
  CDS Start-End: 1-267
atgctgccagatcatttctcacccctctcaggagacattaaactctctgtcctggccttagttgtccttgtggtcctggctcagactgccccagatggatggatcagaaggtgctattatggaactggcagatgcaggaaatcatgcaaagaaattgagaggaagaaagaaaaatgtggggaaaaacatatttgctgtgtccctaaagaaaaggataaactatcacacattcacgaccaaaaagagacaagtgagctatatatctag

SEQ ID NO: 125931 - DNA, 309 bp, Homo sapiens
  Payload ID: 4685
  Gene Symbol: DEFB116
  Gene Name: defensin, beta 116
  Uniprot ID: Q30KQ4
  ENST ID: ENST00000400549
  CDS Start-End: 1-309
atgtcagtcatgaagccctgtttaatgaccattgccatccttatgatcctggctcaaaagactccaggtggcctgttcagatcccacaatggcaagagccgagagccttggaatccatgtgagctttaccaaggcatgtgcagaaacgcctgcagagaatatgaaatccaatacttaacctgcccaaatgatcaaaagtgctgcctgaaactttctgtgaaaataaccagttctaaaaatgtgaaggaggattacgactctaactccaacttgtcagttacaaacagttcaagctactctcacatttga

SEQ ID NO: 125932 - DNA, 1158 bp, Homo sapiens
  Payload ID: 4686
  Gene Symbol: DEFB118
  Gene Name: defensin, beta 118
  Uniprot ID: Q96PH6
  ENST ID: ENST00000253381
  CDS Start-End: 34-405
cctggatctaccacctcctgcttcccaaggaccatgaaactcctgctgctggctcttcctatgcttgtgctcctaccccaagtgatcccagcctatagtggtgaaaaaaaatgctggaacagatcagggcactgcaggaaacaatgcaaagatggagaagcagtgaaagatacatgcaaaaatcttcgagcttgctgcattccatccaatgaagaccacaggcgagttcctgcgacatctcccacacccttgagtgactcaacaccaggaattattgatgatattttaacagtaaggttcacgacagactactttgaagtaagcagcaagaaagatatggttgaagagtctgaggcgggaaggggaactgagacctctcttccaaatgttcaccatagctcatgacttcctctcggctatcactcacccctgtcctcagagtgataaactaagtcacatacagataaagcactgaaaacaccacagtgaccctcccaccccccaccaatatgtaattctattaatagaaacagctgtgtaaagaagtctaaaattttcactatttccaatgataaactcttcagtgctcttcttgaaatgtcacattatttccacaacaagttataacctatttttagtatttcttgtttgctagtgacctatgcacaacttcaatagcttagttagctattccaacaacaatttcttcatgtatcgttctgtcttctcaacagctgtcttcatggcagcataagtggtcatgatcaaaattctaaatctttgcatctgtgagagtagctactatgacactaaaagctttttttctagaacaggagacacttcaggtgaaagcattcattctcctactaactatggccttggagccaggttttatctctcactgtaggaaattggccgccccaggtgtgagctatgaagactcctttttgccccagtggctttggggttgaaatgctgtcgaaaagcttttatggctctgtagacccatctttttgaccaagccttgatcacacatggacatccaagggtaatcatggacccccaattgtgggtgaaaggatggatcatttatctacctgattactgagagctttatttgtctccctctgatagcaaaaaaaaaaaaaaaaaaaaaaa

SEQ ID NO: 125933 - DNA, 484 bp, Homo sapiens
  Payload ID: 4687
  Gene Symbol: DEFB119
  Gene Name: defensin, beta 119
  Uniprot ID: Q8N690
  ENST ID: ENST00000339144
  CDS Start-End: 108-239
gcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcagctctggtgaggacagtgggatgctgcctggatactgccaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttgagtgctggtgattaccattctcaagctctctgggcacagagacctgctgtcaacccccctcattaaaattcatgtgcctgcta

SEQ ID NO: 125934 - DNA, 324 bp, Homo sapiens
  Payload ID: 4687
  Gene Symbol: DEFB119
  Gene Name: defensin, beta 119
  Uniprot ID: Q8N690
  ENST ID: ENST00000376315
  CDS Start-End: 1-267
atgaaacttctttacctgtttcttgccatccttctggccatagaagaaccagtgatatcagtagagtgttggatggatggacactgccggttgttgtgcaaagatggtgaagacagcatcatacgctgccgaaatcgtaaacggtgctgtgttcctagtcgttatttaacaatccaaccagtaacaattcatggaatccttggctggaccactcctcagatgtccacaacagctccaaaaatgaagacaaatataactaatagatagaaatgactttgtttcaggttgcttagggtccacatttcattaaaactcacaaatttg

SEQ ID NO: 125935 - DNA, 457 bp, Homo sapiens
  Payload ID: 4687
  Gene Symbol: DEFB119
  Gene Name: defensin, beta 119
  Uniprot ID: Q8N690
  ENST ID: ENST00000376321
  CDS Start-End: 121-375
gttctaattcactgcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttgagtgctggtgattaccattctcaagctctctgggcacagagacctgctgtcaacccccctcattaaaattcatgtgcctgcta

SEQ ID NO: 125936 - DNA, 389 bp, Homo sapiens
  Payload ID: 4688
  Gene Symbol: DEFB121
  Gene Name: defensin, beta 121
  Uniprot ID: Q5J5C9
  ENST ID: ENST00000376314
  CDS Start-End: 115-345
gctctgccatgctcctcaaggcaataaataccagtctggactgcccagaatggagtcctctgtctgttttaccagttgagaagcctcctatccctccctgatcattcatcattcatgaagctccttcttctgcttttgactgttactctgctcctggcccaggtcaccccagtcatgaaatgttggggcaagtcaggcaggtgcagaacaacatgtaaagaaagtgaagtatactatatattatgcaaaactgaggctaagtgctgtgtggatcccaagtatgtacctgtaaaaccaaaattaacagacacaaatacaagcctggaatcaacttctgcagtctgacacctctcttccaaccttgagtctcaacatcatgggatcctgca

SEQ ID NO: 125937 - DNA, 467 bp, Homo sapiens
  Payload ID: 4689
  Gene Symbol: DEFB123
  Gene Name: defensin, beta 123
  Uniprot ID: Q8N688
  ENST ID: ENST00000376309
  CDS Start-End: 181-384
ccttgttggctgtcctctccctgctgacctaaatgacaaagggaggggtgtccagtcagagtgtgagggctgtacccgtgggcagctgagggagtgcgagccacaggccaggcactctccttctcccattagctcagccgtggcatcggacttgcagcttcattttgggctgccttagccatgaagctccttttgctgactttgactgtgctgctgctcttatcccagctgactccaggtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaactgctttgaagcctgaagccatgaaaatgcagatgaagctcccagtggattcccacactctatcaataaacacctctggctga

SEQ ID NO: 125938 - DNA, 216 bp, Homo sapiens
  Payload ID: 4690
  Gene Symbol: DEFB124
  Gene Name: defensin, beta 124
  Uniprot ID: Q8NES8
  ENST ID: ENST00000317676
  CDS Start-End: 1-216
atgacacagctgcttctgttccttgtggctctcctggttctgggtcatgtgccatcagggagaagtgaattcaaacggtgctggaagggtcaaggggcctgccaaacttactgcacaaggcaagaaacttacatgcacctgtgcccggatgcgtccctgtgctgtctctcctatgcattgaaacctccaccggtccccaagcatgaatatgagtag

SEQ ID NO: 125939 - DNA, 587 bp, Homo sapiens
  Payload ID: 4691
  Gene Symbol: DEFB125
  Gene Name: defensin, beta 125
  Uniprot ID: Q8N687
  ENST ID: ENST00000382410
  CDS Start-End: 1-471
atgaatatcctgatgctgaccttcattatctgtgggttgctaactcgggtgaccaaaggtagctttgaaccccaaaaatgttggaagaataatgtaggacattgcagaagacgatgtttagatactgaaaggtacatacttctttgtaggaacaagctatcatgctgcatttctataatatcacatgaatatactcgacgaccagcatttcctgtgattcacctagaggatataacattggattatagtgatgtggactcttttactggttccccagtatctatgttgaatgatctgataacatttgacacaactaaatttggagaaaccatgacacctgagaccaatactcctgagactactatgccaccatctgaggccactactcccgagactactatgccaccatctgagactgctacttccgagactatgccaccaccttctcagacagctcttactcataattaattaacatttacttctggtatggaacaactagaaatactgctggaaataatatccaaagagctgattctaccaatccaatttcaccaggaaaattccatcagggattggatgaccat

SEQ ID NO: 125940 - DNA, 655 bp, Homo sapiens
  Payload ID: 4692
  Gene Symbol: DEFB126
  Gene Name: defensin, beta 126
  Uniprot ID: Q9BYW3
  ENST ID: ENST00000382398
  CDS Start-End: 261-596
gccatacacttcagcagagtttgcaacttctcttctaagtctttatccttcccccaaggcatgcctagcacaggactcttgaacagtgatgcctcaattagagttgctagccaatagattgaagctatgttggcacaatatcctacatcctcccgatctactggctgagcccaaccccacctaagaaggacaataaagatctgtgttcagagtcatactgaatagagacttctggactctatagaacccactgcctcctgatgaagtccctactgttcacccttgcagtttttatgctcctggcccaattggtctcaggtaattggtatgtgaaaaagtgtctaaacgacgttggaatttgcaagaagaagtgcaaacctgaagagatgcatgtaaagaatggttgggcaatgtgcggcaaacaaagggactgctgtgttccagctgacagacgtgctaattatcctgttttctgtgtccagacaaagactacaagaatttcaacagtaacagcaacaacagcaacaacaactttgatgatgactactgcttcgatgtcttcgatggctcctacccccgtttctcccactggttgaacattccagcctctgtctcctgctctaggatccccgactcattaaagcaaagaggctta

SEQ ID NO: 125941 - DNA, 514 bp, Homo sapiens
  Payload ID: 4693
  Gene Symbol: DEFB127
  Gene Name: defensin, beta 127
  Uniprot ID: Q9H1M4
  ENST ID: ENST00000382388
  CDS Start-End: 76-375
ctctgaggaaggtagcatagtgtgcagttcactggaccaaaagctttggctgcacctcttctggaaagcctggccatggggctcttcatgatcattgcaattctgctgttccagaaacccacagtaaccgaacaacttaagaagtgctggaataactatgtacaaggacattgcaggaaaatctgcagagtaaatgaagtgcctgaggcactatgtgaaaatgggagatactgttgcctcaatatcaaggaactggaagcatgtaaaaaaattacaaagccacctcgtccaaagccagcaacacttgcactgactcttcaagactatgttacaataatagaaaatttcccaagcctgaagacacagtctacataaatcaaatacaatttcgttttcacttgcttctcaacctagtctaataaactaaggtgatgagatatacatcttcttccttttggtttcttgatccttaaaatgaccttcgagcatattctaataaagtgcattgccagtt

SEQ ID NO: 125942 - DNA, 373 bp, Homo sapiens
  Payload ID: 4694
  Gene Symbol: DEFB128
  Gene Name: defensin, beta 128
  Uniprot ID: Q7Z7B8
  ENST ID: ENST00000334391
  CDS Start-End: 59-340
ggcacacagaccactggacaaagttctgctgcctctttctcttgggaagtctgtaaatatgaagctgtttctggttctcattattctgctgtttgaggtactcacagacggggcaagactcaaaaaatgcttcaataaagtaacaggctattgcaggaagaaatgcaaggtaggagaaagatatgaaataggatgtctaagtgggaaattatgttgtgctaatgatgaagaagagaaaaaacatgtgtcatttaagaagccacatcaacattctggtgagaagctgagtgtgctgcaggattacatcatcttacccaccatcaccattttcacagtctaatcctaaatctagcccttgtctcgctggtctcca

SEQ ID NO: 125943 - DNA, 698 bp, Homo sapiens
  Payload ID: 4695
  Gene Symbol: DEFB129
  Gene Name: defensin, beta 129
  Uniprot ID: Q9H1M3
  ENST ID: ENST00000246105
  CDS Start-End: 32-583
agattcaaggcttcctctctggcacccaaccatgaagctcctttttcctatctttgccagcctcatgctacagtaccaggtgaacacagaatttattggcttgagacgctgtttaatgggtttggggagatgcagggatcactgcaatgtggatgaaaaagagatacagaaatgcaagatgaaaaaatgttgtgttggaccaaaagtggttaaattgattaaaaactacctgcaatatggaacaccaaatgtacttaatgaagacgtccaagaaatgctaaaacctgccaagaattctagtgctgtgatacaaagaaaacatattttatctgttctcccccaaatcaaaagcactagcttttttgctaataccaactttgtcatcattccaaatgccacccctatgaactctgccaccatcagcactatgaccccaggacagatcacatacactgctacttctaccaagagtaacaccaaagaaagcagagattctgccactgcctcgccaccaccagcaccacctccaccaaacatactgccaacaccatcactggagctagaggaagcagaagagcagtaatgtggatctttcccttaaaactccaagttcctctctatttttgctatctataaaatgacatagaactgtttcctctgtcatcagtcattcaataaacactgtttgagcacctaca

SEQ ID NO: 125944 - DNA, 240 bp, Homo sapiens
  Payload ID: 4696
  Gene Symbol: DEFB130
  Gene Name: defensin, beta 130
  Uniprot ID: Q30KQ2
  ENST ID: ENST00000400079
  CDS Start-End: 1-240
atgaaactccattcccttatttctgttctcctcctctttgtgactttaataccaaaaggaaagactggcgttattccaggacaaaaacagtgtattgctttgaaaggggtgtgcagagacaaactatgcagcacactagatgataccattggtatatgtaatgaaggaaaaaaatgttgtagaaggtggtggatacttgagccctatccaactccggttcccaaaggaaaatctccttag

SEQ ID NO: 125945 - DNA, 213 bp, Homo sapiens
  Payload ID: 4697
  Gene Symbol: DEFB131
  Gene Name: defensin, beta 131
  Uniprot ID: P59861
  ENST ID: ENST00000334879
  CDS Start-End: 1-213
atgagggtcttgttttttgtctttggagtcctttccttgatgttcacagttcctccagccagaagcttcatttctaatgatgaatgtccttcagaatattatcattgcagactgaagtgcaatgctgatgaacatgcaattagatactgtgctgacttcagcatctgctgcaaactgaagatcattgaaattgacggacaaaagaagtggtga

SEQ ID NO: 125946 - DNA, 2121 bp, Homo sapiens
  Payload ID: 4698
  Gene Symbol: DEFB132
  Gene Name: defensin, beta 132
  Uniprot ID: Q7Z7B7
  ENST ID: ENST00000382376
  CDS Start-End: 44-331
ctccattaaaccaccaccagctccccaagccaccccttcagccatgaagttcctgctcctggtcttggcagccctcggattcctgacccaggtgatcccagccagtgcaggtgggtcaaaatgtgtgagtaacaccccaggatactgcaggacatgttgccactggggggagacagcattgttcatgtgcaacgcttccagaaaatgctgcatcagctactccttcctgccgaagcctgacctaccacagctcatcggtaaccactggcaatcaaggagaagaaacacacaaaggaaagacaagaagcaacaaacgaccgtaacatcataataaccactgctatcgcctccaccaactcagagaaatatcatttccacagttccaattcctcctacattgctgagtactagccaaggctcctctttatggggcagatatctatagccaaccccaaaacttctgtcttctatcattctgtcattcatctagtaactaatttggagtttgtatctatcttacgagaacaatcatcatgcagattcgtccacaggggatctgtcagtttgggtcctccaaatgaaaaatgtcaagacagaattggacatgcaaaagattgactgggagaacacacctctgatggacaaaggtgagacagagcagccacaggcagggagagccttcagactgcaacgctggcctgatacgtgtcaaaggagagagggatagaggaggattgaatagaaggagactaagactgcagctctaagaaagtctcagccaaacagatggggaggcccaaagcaaggcttgcccctcagaggagctcacgcagggcaggaatagccaggttctcatatcccaggggttcagactttggctgagaacagcccctggagaacatggggtgactgctaccataggtctggaagtatgaggctgtccaccaactatccccttgaagcaagttctcttgaaaggaaatctaaacagtgcacccccatggctgccacggagtataaggagggagagaaaggagctgaaagtctaggtttggccagctaggtagactgacttgtgaggtatttatttattcatttgagtaacaaagcagacagaatacatagccaccattggtagtacaccccaaaagcaaggatggcatgatgctggtgactcaaacgtgcctactcatggtgtcaaattggcataatcctcttgggaagctgtgtggaaataagcacagagaagcagaactctaattgcttaatccactaaacattacttctgggaattggctcatcataaattatccaagagaagcacaaagttatgggcacaaaggttttccatataatattatttaaaatgctgagaaaatgaaaaaatctaaatggtgaaatatatactaatgccatctataaatacaaacaaatagaatgtttatagaataatggaacataataacattattcaaaattgcatttatgctatagttgtcaaaattgtctccttatatgatacaaaactcatgaaaattatgacttttttgtttggttggaaagcagaattatgcataaatttcctcttacagttcgatgcccattagttttatataacatttatttgacacgtactgacttctatctgagaagaacaaaccaaaacactcaggcctaaataattaaaaacggtcctaaaaactagcaaaccagataagaaaagatgttaatgcccattccctaacttatgtcttagaccaaaattaattctagatggttttaaaatgacagtgtaaaagtaaagtattaaaagattgtgtggtcaaatattcaatttaagagcaaggaaattcttataaatataacaatagaggcagaactcatgtaagaataaattgattaggtggtattaaatattaagttcttatgtatgtcaaaagatatcattttgaaattcatccatcttattgggtattgcaggagttcattcctttttgtttataaatactcttccgtcatatgaatagtattcatttgtatactggtttgttgatggacatttgggttgttcccagtttatggctattacaaataaagcttctatgaacatttatgtacaaa

SEQ ID NO: 125947 - DNA, 186 bp, Homo sapiens
  Payload ID: 4699
  Gene Symbol: DEFB133
  Gene Name: defensin, beta 133
  Uniprot ID: Q30KQ1
  ENST ID: ENST00000398721
  CDS Start-End: 1-186
atgaagattcacgtctttctctttgttttatttttctttctggtccccattgccaccagggtgaaatgtgccgtgaaagacacctatagttgctttatcatgagaggcaaatgtcgacatgagtgtcatgattttgaaaaaccaattggtttctgcacaaaactaaatgccaactgttatatgtag

SEQ ID NO: 125948 - DNA, 314 bp, Homo sapiens
  Payload ID: 4700
  Gene Symbol: DEFB134
  Gene Name: defensin, beta 134
  Uniprot ID: Q4QY38
  ENST ID: ENST00000382205
  CDS Start-End: 62-262
ctgttccctgacagccgatgtcagaccctgccactagcctccttaacagaagttcccagccatgaagcctctccttgttgtgtttgtctttcttttcctttgggatccagtgctggcaggtataaattcattatcatcagaaatgcacaagaaatgctataaaaatggcatctgcagacttgaatgctatgagagtgaaatgttagttgcctactgtatgtttcagctggagtgctgtgtcaaaggaaatcctgcaccctgacataagaaaccaatgaatggccactatcctgtaggcccttgattctgccatc

SEQ ID NO: 125949 - DNA, 1068 bp, Homo sapiens
  Payload ID: 4700
  Gene Symbol: DEFB134
  Gene Name: defensin, beta 134
  Uniprot ID: Q4QY38
  ENST ID: ENST00000526438
  CDS Start-End: 62-262
ctgttccctgacagccgatgtcagaccctgccactagcctccttaacagaagttcccagccatgaagcctctccttgttgtgtttgtctttcttttcctttgggatccagtgctggcaggtataaattcattatcatcagaaatgcacaagaaatgctataaaaatggcatctgcagacttgaatgctatgagagtgaaatgttagttgcctactgtatgtttcagctggagtgctgtgtcaaaggaaatcctgcaccctgacataagaaaccaatgaatggccactatcctgtaggcccttgattctgccatctttcacaaaaccagggaatttagatcaaactgtgacaccatgatgtgtccatgactactggtttttagcatttttataggccagcagactcttgtggtcttaaatttaaagagctgagctgtagccttctttaaaagagctcggtttttcacaaaaacaatgtagaagatattttctcacctcaacgtgatgtccagtgtgctcatcagcacctgtttctccctctaatcatagaggatattcttattatttagaaaggcttcaagggaaacaacttttgacacctaagtcgtgtcctaccttcgcttcagcttcgcatttcccatttctgtgaaattcccaactttagagaagcagatttgccatggccttctgacaaccttgtacatctctcacataaaccgcataggcagggcttaactacaggctggcccgagtctgcactgagtctgaccctgaagttcctttggaacaggagaggccatcttgtgatgggctggaacaaggtaatttctcatccacctccctagtttcagttgagcaatggaacttcccacctgagcccctagggttcagctacaggctataagactgccgtcctgtggtttagtgttggttccttagcagcagagtgatgccacctctgctgcccgtcatctgactcctctggatgggtgttatcctgtggcttaagagctaacaccatgctgatcttgctttgctatatgtgtaactaataaactgcctaaatgca

SEQ ID NO: 125950 - DNA, 234 bp, Homo sapiens
  Payload ID: 4701
  Gene Symbol: DEFB135
  Gene Name: defensin, beta 135
  Uniprot ID: Q30KP9
  ENST ID: ENST00000382208
  CDS Start-End: 1-234
atggccacaaggagcgtcctcttggccctcgtggtccttaacttactcttctatgttccaccaggtagaagtggacccaatgtctacatacaaaaaatctttgcttcatgttggcgactgcaaggtacttgccggccaaaatgtctaaaaaacgaacaatatcgtattttgtgtgatactatacatttgtgctgtgtaaacccaaaatatttacctatactgactgggaaatag

SEQ ID NO: 125951 - DNA, 237 bp, Homo sapiens
  Payload ID: 4702
  Gene Symbol: DEFB136
  Gene Name: defensin, beta 136
  Uniprot ID: Q30KP8
  ENST ID: ENST00000382209
  CDS Start-End: 1-237
atgaacctctgtctttctgcattactctttttcctggtgatcttactgccttcaggaaaaggtatgtttgggaatgatggagtcaaagttcgcacctgcactagccagaaagccgtatgtttcttcgggtgtccgccaggatacaggtggattgcgttctgccacaatattctgtcttgctgtaaaaatatgacacgttttcaacccccgcaagccaaagatccatgggttcattaa

SEQ ID NO: 125952 - DNA, 380 bp, Homo sapiens
  Payload ID: 4703
  Gene Symbol: DEFB4A
  Gene Name: defensin, beta 4A
  Uniprot ID: O15263
  ENST ID: ENST00000302247
  CDS Start-End: 85-279
gaccagggaccaggacctttataaggtggaaggcttgatgtcctccccagactcagctcctggtgaagctcccagccatcagccatgagggtcttgtatctcctcttctcgttcctcttcatattcctgatgcctcttccaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagata

SEQ ID NO: 125953 - DNA, 332 bp, Homo sapiens
  Payload ID: 4704
  Gene Symbol: DEFB4B
  Gene Name: defensin, beta 4B
  Uniprot ID: O15263
  ENST ID: ENST00000318157
  CDS Start-End: 37-231
agactcagctcctggtgaagctcccagccatcagccatgagggtcttgtatctcctcttctcgttcctcttcatatttctgatgcctcttccaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagata

SEQ ID NO: 125954 - DNA, 332 bp, Homo sapiens
  Payload ID: 4704
  Gene Symbol: DEFB4B
  Gene Name: defensin, beta 4B
  Uniprot ID: O15263
  ENST ID: ENST00000617136
  CDS Start-End: 37-231
agactcagctcctggtgaagctcccagccatcagccatgagggtcttgtatctcctcttctcgttcctcttcatattcctgatgcctcttccaggtgtttttggtggtataggcgatcccgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggttccctcatcagagacgtgcgacatgtaaaccaaattaaactatggtgtccaaagata

SEQ ID NO: 125955 - DNA, 1403 bp, Homo sapiens
  Payload ID: 4705
  Gene Symbol: DHDDS
  Gene Name: dehydrodolichyl diphosphate synthase subunit
  Uniprot ID: Q86SQ9
  ENST ID: ENST00000236342
  CDS Start-End: 94-1095
actgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttcttttt

SEQ ID NO: 125956 - DNA, 3245 bp, Homo sapiens
  Payload ID: 4705
  Gene Symbol: DHDDS
  Gene Name: dehydrodolichyl diphosphate synthase subunit
  Uniprot ID: Q86SQ9
  ENST ID: ENST00000360009
  CDS Start-End: 78-1082
cgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattc

SEQ ID NO: 125957 - DNA, 1148 bp, Homo sapiens
  Payload ID: 4705
  Gene Symbol: DHDDS
  Gene Name: dehydrodolichyl diphosphate synthase subunit
  ENST ID: ENST00000374185
  CDS Start-End: 91-720
gaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccaggtatcccgagttgttttgcatggtaattgttaaggaaaacaggcctgggccagcatggcagctcacgcctgtaatcctagcacattaggaggccgaggtgggcagtccacttgaggcaggccaggagttcaagaccagcctggccaacatggcaaaactccctcttttcaacaacaacaacaaaaaagcaggcctgtaccaaaccataaagcccctctgtgccatgtacttggccagaggtctaattaggggagcatgtggaaagatttaaggggatctcccaaatttagagattaggattggcttattacaacctgcttcagaactagagttcaccacacaccaagaaaccccagagaaagagcaaagcagatgacaaagccatgttattattcctttacaaattataccctcctggccctttggtagtgtttttccaagaatgacttttcatgaatgcagtttgttggggctagagttctttaggtctctcatgttctagttccacacaagatt

SEQ ID NO: 125958 - DNA, 629 bp, Homo sapiens
  Payload ID: 4705
  Gene Symbol: DHDDS
  Gene Name: dehydrodolichyl diphosphate synthase subunit
  ENST ID: ENST00000416052
  CDS Start-End: 1-487
gcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagcacccagggagcctcctgaccaaggcctggaagaagcccttccagcaagacggagagctctacggcaactgttcaagcccgaagtcctcatagctccacatgtaattcattgtaatagcagaagagaagtattcttgaatgcctgggattattcaggagccgggggggacagtccagaattctcatttgtcatccttattcatgcagtaaacctttattgctgagagacagcaaa

SEQ ID NO: 125959 - DNA, 703 bp, Homo sapiens
  Payload ID: 4705
  Gene Symbol: DHDDS
  Gene Name: dehydrodolichyl diphosphate synthase subunit
  ENST ID: ENST00000430232
  CDS Start-End: 56-703
attacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcag

SEQ ID NO: 125960 - DNA, 868 bp, Homo sapiens
  Payload ID: 4705
  Gene Symbol: DHDDS
  Gene Name: dehydrodolichyl diphosphate synthase subunit
  ENST ID: ENST00000427245
  CDS Start-End: 117-713
acgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtcgagacaggtttcaccatattggccaggctagtctcgaactcctgacgtcgtgatctgcctgcctcagcctcccaaagtgctgggattacaggcgtgagtcaccatgcccagccgattcagggatttttcaaaaagaaaattattaattattgtcaacatagtggaatcctaattattaaaggtggagagacttttgaagccatttaaa

SEQ ID NO: 125961 - DNA, 2673 bp, Homo sapiens
  Payload ID: 4705
  Gene Symbol: DHDDS
  Gene Name: dehydrodolichyl diphosphate synthase subunit
  ENST ID: ENST00000431933
  CDS Start-End: 1-510
ctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaatgatatctctgagtctctgcttgataagtgcctctataccaaccgctctcctcatcctgacatcttgatacggacttctggagaagtgcggctgagtgacttcttgctatggcagcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattc

SEQ ID NO: 125962 - DNA, 3338 bp, Homo sapiens
  Payload ID: 4705
  Gene Symbol: DHDDS
  Gene Name: dehydrodolichyl diphosphate synthase subunit
  ENST ID: ENST00000434391
  CDS Start-End: 151-372
gcagcgcccaaagatgacgtgttctgccagcgccacgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagctccttgccttctcccctctcagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcaccaatagggtttggagagcaaagggccacaactcatcagctgcctgtctcttagatgcactttctttttccaccagcacatccttcaacacacagaatttcagggaagagttctccccaaaaccctagctctttacccttccattttagccttccacccagcttccacaaaagatttggctctaccttggatctgctagtaaataactaataggcaggcagttatttgggtaaggaaaaaaggggtgggagagacagaaaatttgcccatctgctgctcctcccccttggctctccacctgggatttgctattgaatctctaccctctcccaccacacagtactgattgctcactgaaagactcagcacccccaatggtgcgcggaagccaggcgggcgattacaatccaattacctattgtcgactcagcccacacaagcttttctcctcctcttgcagggcatggggccaggctccactcccaaatgagactggccccctccatggttcagggtaacagaagggcctgtaggccctggtgaactgaatccagcacaggcctcccctgtaacacaacaggactgagcagaaccaaacacttcttccaactgactctgctccctgccctcaccatctcaaactctgattcccactccactcttcgaggtttctctcagctttttgacctggctccctaagtaggccctagatgatttattcttggcatggcaaagcttgttctaggtcctctgcttgtgagggtcaaagctgtgtcctttcccttacctccctctgccaggacttgctgcagagctgctgagaggattagtgcctttgaagagctgtctgcctgagcaactctatttcaggtgccccacaccggcaagtaccagccagcaacaccaaccaaatgctactctctttaaagtccattttccttcttctttttttttttttttttggagacagcatctcaccctgtcctggctggtctcgaactcctgacctcaggtgatccgccggcctcaccctcccaaagtgctgggattacaggcatgagccaccatgccagacttcccattttactttctgcaagctgtttccctagcagctccctctaggggagaggtgaaatcttgcaagttgtagcaagagcacacaggaaacccctaactttcctataccccacccgcctcttcccctttctgtcccgggatacctggcggcaagagacttcttggctattgtccatgctcccagaatcaagcataaatgccagacacggcgattgagaagccaatcagtgaaccctttggcaaagcccccatccacacctggcactcccctctaccaatccctggcacagggttcctggagagcaggtgctgtacattttacagctttacaatggggctgttgacagccataattagggaggcatgaattatgcggctataatgcagagccctacaattaaggcgggaatgaggggctggaggcagcaaacggaatctgccctatgagcgtggctgttgagtcctgtctcctgggtctgactttccgtaatatgattggggtacagtagaggtgattaatggggctggcatctctctttggcctgaggttctgtattctgggaaaggtacacagggtggagtagggagaagctgccccaggaggcgatgtagtggtggaaagaagaggcagagaggtcgtcgtcgtcgcccagcagcaagggctgcaaaatagtagaactcgtggttgctttggacaggtgtgatttgtgcaagccaggttcaacccttgcctcaagaaatcagatgggaccaatttagtgtccttccacctgtgagccaagcccccatttgaggacatctatcgtattcttgtgtgctgggtctcaaatagaatttttaaagattc

SEQ ID NO: 125963 - DNA, 705 bp, Homo sapiens
  Payload ID: 4705
  Gene Symbol: DHDDS
  Gene Name: dehydrodolichyl diphosphate synthase subunit
  ENST ID: ENST00000436153
  CDS Start-End: 185-705
gaaggggtgaactagaggagaagagggtgactgggcggggagcagctgcgggagaagcaaagggacgactgagggaataatcaggagaccactgaggcgtgaagtactaggcgtgcgataactgaaggaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgtgagagagatggcctggggggtgga

SEQ ID NO: 125964 - DNA, 492 bp, Homo sapiens
  Payload ID: 4705
  Gene Symbol: DHDDS
  Gene Name: dehydrodolichyl diphosphate synthase subunit
  ENST ID: ENST00000525326
  CDS Start-End: 280-492
aatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatccta

SEQ ID NO: 125965 - DNA, 556 bp, Homo sapiens
  Payload ID: 4705
  Gene Symbol: DHDDS
  Gene Name: dehydrodolichyl diphosphate synthase subunit
  ENST ID: ENST00000530781
  CDS Start-End: 377-556
agaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaagtcagtgcagatacggaggaaatgggaatgggaagaagtctgcaaagccaggagaaccgaggaaaggcttttgcctccagagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgag

SEQ ID NO: 125966 - DNA, 581 bp, Homo sapiens
  Payload ID: 4705
  Gene Symbol: DHDDS
  Gene Name: dehydrodolichyl diphosphate synthase subunit
  ENST ID: ENST00000525546
  CDS Start-End: 327-581
aatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggagttagtaactgggagcacagagttggaaacagcttaggggaagatggagaaggaagaaacggggaatgatcaagatgtgggcaccatgatgtggcaggaaaccgacttagatgttcagaagaaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgc

SEQ ID NO: 125967 - DNA, 573 bp, Homo sapiens
  Payload ID: 4705
  Gene Symbol: DHDDS
  Gene Name: dehydrodolichyl diphosphate synthase subunit
  ENST ID: ENST00000525165
  CDS Start-End: 207-573
gctaatcaggtgccactgaactgaaggggtgaactagaggagaagagggtgactgggcggggagcagctgcgggagaagcaaagggacgactgagggaataatcaggagaccactgaggcgtgaagtactaggcgtgcgataactgaaggaattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcg

SEQ ID NO: 125968 - DNA, 1072 bp, Homo sapiens
  Payload ID: 4705
  Gene Symbol: DHDDS
  Gene Name: dehydrodolichyl diphosphate synthase subunit
  Uniprot ID: Q86SQ9
  ENST ID: ENST00000526219
  CDS Start-End: 93-977
ctgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaagtgtttcctgaatgtctgttttgcatacacatcccgtcatgagatcagcaatgctgtgagagagatggcctggggggtggagcaaggcctgttggatcccagtgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataa

SEQ ID NO: 125969 - DNA, 1235 bp, Homo sapiens
  Payload ID: 4705
  Gene Symbol: DHDDS
  Gene Name: dehydrodolichyl diphosphate synthase subunit
  Uniprot ID: Q86SQ9
  ENST ID: ENST00000525682
  CDS Start-End: 94-993
actgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaatgatatctctgagtctctgcttgataagtgcctctataccaaccgctctcctcatcctgacatcttgatacggacttctggagaagtgcggctgagtgacttcttgctatggcagacctctcactcctgcctggtgttccaacccgttctgtggccagagtatacattttggaacctcttcgaggccatcctgcagttccagatgaaccatagcgtgcttcagaaggcccgagacatgtatgcagaggagcggaagaggcagcagctggagagggaccaggctacagtgacagagcagctgctgcgagaggggctccaagccagtggggacgcccagctccgaaggacacgcttgcacaaactctcggccagacgggaagagcgagtccaaggcttcctgcaggccttggaactcaagcgagctgactggctggcccgtctgggcactgcatcagcctgaatgaggctggccacctgccactttgccctgccctctgcctccagggctccactccccttccttttcttggtgaaaggcacctcctttcctgataatgaatggtgttccctttgcttggctggggagccccccaggccaggtttgctggccatagatacctttgggctgcctgggacaggctcctgaggaggattgagggtgaaagtctcccacgagtacactaaacctaggtctggtcacca

SEQ ID NO: 125970 - DNA, 582 bp, Homo sapiens
  Payload ID: 4705
  Gene Symbol: DHDDS
  Gene Name: dehydrodolichyl diphosphate synthase subunit
  ENST ID: ENST00000533087
  CDS Start-End: 86-582
gagctaatcaggtgccactgaactgaagggattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatctccaggagctgattgcacaagctgtacaggccacgaagaactacaacaagtgtttcctgaatgtctgttttgcatacacatcccgtcatgagatcagcaatgctgt

SEQ ID NO: 125971 - DNA, 496 bp, Homo sapiens
  Payload ID: 4705
  Gene Symbol: DHDDS
  Gene Name: dehydrodolichyl diphosphate synthase subunit
  ENST ID: ENST00000531312
  CDS Start-End: 105-496
agctaatcaggtgccactgaactgaaggggtgaactagaggagaagaggattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacgggaaccgtcgctatgccaagaagtgccaggtggagcggcaggaaggccactcacagggcttcaacaagctagctgagactctgcggtggtgtttgaacctgggcatcctagaggtgacagtctacgcattcagcattgagaacttcaaacgctccaagagtgaggtagacgggcttatggatctggcccggcagaagttcagccgcttgatggaagaaaaggagaaactgcagaagcatggggtgtgtatccgggtcctgggcgatctgcacttgttgcccttggatct

SEQ ID NO: 125972 - DNA, 5159 bp, Homo sapiens
  Payload ID: 4706
  Gene Symbol: DHTKD1
  Gene Name: dehydrogenase E1 and transketolase domain containing 1
  Uniprot ID: Q96HY7
  ENST ID: ENST00000263035
  CDS Start-End: 63-2822
cagggccggtgggatcccctcgggctcccgccttagcatgctggccgggacatctggtgaacatggcctctgctactgcggcagcagcacgacggggcctcggccgggctctccctctcttctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcaggagtttgaccactttctggccaccaagttctcgacagtgaagcgatatggaggcgaaggggctgaaagcatgatgggctttttccacgagctgctgaaaatgtcggcctacagcgggatcactgatgtcattattgggatgccccatagagggaggctgaatttattgacaggccttctgcagttccctccagagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatcgtggtttgccaggagacggatgacacctacatccccctgaaccatatggacccaaatcagaaggggtttctagaggtcagcaacagcccactgtcagaagaggccgtcctgggatttgaatatgggatgagcattgagagcccaaagttactgcccctgtgggaggcacagtttggcgatttcttcaatggtgcccagatcatctttgacacattcatctctggaggagaggccaagtggctcctacaaagcggcatcgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactcattgttgcttcccctaagatgttactcaggctcccggcagccgtgtcaactcttcaagaaatggcaccaggaacaacatttaacccggtcattggtgattcatctgtggatccaaaaaaggttaagaccctcgtgttctgctccggcaaacatttctactccctggtgaaacaaagagaatctctgggggccaagaagcatgactttgccatcatccgagtagaggaactctgccccttcccgttggattctttacagcaagagatgagcaaatacaaacatgttaaagatcatatttggagtcaggaggaacctcagaacatgggtccgtggtcgtttgtttctccaaggtttgaaaagcagctggcctgcaagctccgtctggtgggccggccccctttgccagtacccgctgtaggaattggcacagttcacttgcaccagcatgaagatatcctcgccaagaccttcgcttgatgatgacttttgaagaaacactatttctctttaagaaaatggccattaaggccgggtggggtggcacatgcctgtaatcccagcactttgggaggccaaggctggtggatcacctgaggtcaggagttcgagaccagcctggccaacacggtgaaaccccgcctctactaaaaatacaaaaaatagccgggtgtggtggtgggcacctgtgatcccagcttcctgggaggctgaggcaagagaatcgcttgaatctgggaggcggaggttgcagtgagccaggatcacaccattgctgtccagcctgggtgacagagcaagactgcgtttcaaaaaaaaaaaaaaaaaaacccattaaaagaggcctccttcctccactctctcaacccctctgttgggtaacatgaaaagactgtattcctctaagatgttgggattgatatacgtgatttaatctgcaataggtggaataaccaggggaactggttatgaatatgtgaatgcaaccagcaaatttatccttgaaggtgtgatggtagaaataggaaaacaacaaaagaaaaacaataacaaaaaaagaaagtgtgatggctgggtgcagtggctcacgcctgtaatcccagcactttgggaggcttaggcggctggatcacctgaggtcaggagttcaagaccagcctggtcaacgtggtgaaacgccgtttctactaaaaatatgaaaattagttgggtgtggtggcatgcgcttgtagtctcagctactccggaggctgaggcaggagaattgcttgaacctggaaggcagaggttgcagtgagccgaaatggcgccactgtactccaacctgggcgacagagcaagactccatctcataaattaaaaggaaagtatgatagtgttatggattttagctctgagtgagctggaaaactaggtcattatctagatgatttcagacttgaccctaattgaccatatatgaccaggaaacacttctgagtttacagctccgtggagatgacctcaacactgcctcttgatttgtttgatgcatgtcactttcattaattttccccctcctttttgaaagtcctgtggcagtactaatattttcattttatgtaatctctggtgctgctttccagtcactgtatgaagtgtctccccaacactagcaaatctaggtcctactaaatacaaatctctgggtggatgatcttctagtactgtatttttaaattaaggagttttagttataatgaaattgatttgtagtctgttttgccgtaaacttgtttttctttaaattgttcttacagtgatatcttactatttttaactgtctggggtttctgatatggggatttcagcccctggttaatcagtcttgtccctacaagtccctgatgcagtatgtttatttgtgatgtttaaagaacatttcttggctgggcgctgcggcttgcgcctgtaatctcagcactttgggaggctgagatgggtggatcacctgaggttgggagttcgagaccagcctgacaaaacatagtgaaaccccgtctctactaaaaatacaaaaattagctgggcgtggtggtgggtgtctgtaatcccagctattcgggaggctgaggcaggagaatcgcttgaacccaggaggtggaggttgcagtgagctgagatcctgccactgcactccagtctgggtgacagagcaagactccatctcaaaaaataaataaatagaaagagagagagaggaaaaaaaaagaaaagaacacttctttatttgagggactttcccaacaccaggtgcttggggatttcttagagatcaccaaccgactccctcactgtgaaattaaaccaagtactggaaacgtaactaaacagcgaaccatgtagcttcacctgactcagtgctgggggcctctaccatctactgtgcttgtgtcatgatgctttttctctgaagtggtgtgggaagtaccaggggactggcagaagcccaggccctctctacttttaccagcaactgatcatgtctttcagaatccatgtacatataggctgttctagccacagtggtagatttatgattcacatccgaaagtgtgccttagttatcaatttaacatttctctagtattcatatcccttttcttaccatatacctcagtgtatccttcctgtgtcaagccttataaatcatgtaatttagtgccactcatgtaaatcagtaaaatcacaaaggtctatttaatgaaaacgatttaccaatgttgtttttttttaacaagaaaaaaaataaaagcacattgtcattttttttcctca

SEQ ID NO: 125973 - DNA, 933 bp, Homo sapiens
  Payload ID: 4706
  Gene Symbol: DHTKD1
  Gene Name: dehydrogenase E1 and transketolase domain containing 1
  ENST ID: ENST00000437298
  CDS Start-End: 11-933
tctggtgaacatggcctctgctactgcggcagcagcacgacggggcctcggccgggctctccctctcttctggcgtggctaccagaccgagcggggcgtttacggctaccggccgaggaagcccgagagccgcgagccccagggcgccctggagcgccccccagttgatcatggccttgccaggttggtgacagtatattgtgagcatggtcataaagctgccaaaatcaaccccctcttcaccggacaagccctgctggagaatgtgcctgaaatccaagccctggtgcagacactgcagggacccttccacacggcaggattattgaacatggggaaggaagaggcctcacttgaggaagtgttagtctatctcaatcaaatctactgtgggcagatttctattgaaacctcccaacttcagagccaggatgagaaagactggtttgccaagcggtttgaggaactgcaaaaggagacgtttaccacagaagagcgaaaacatctgtcgaaactaatgctggaatctcagctgatgttccgtaaaatgcgaggcttaagtgaatttccagagaatttctcagccactggagacgtcctgtctcacctgacctcctctgtggacctgtactttggggcgcaccatcccctccatgtgacaatgttgcccaatccctcgcacctggaggccgtcaaccccgtggccgtgggcaaaactcgcggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactcc

SEQ ID NO: 125974 - DNA, 787 bp, Homo sapiens
  Payload ID: 4706
  Gene Symbol: DHTKD1
  Gene Name: dehydrogenase E1 and transketolase domain containing 1
  ENST ID: ENST00000448829
  CDS Start-End: 1-643
caaaatcatcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcagtccagaatggagaagatgatggacggaatcaagctagactgggccaccgcggaagctcttgccttgggttctttacttgctcaaggttttaatgttcgtctaagtggccaagatgttggtcgtggaactttcagtcagaggcatgcaatcgtggtttgccaggagacggatgacacctacatccccctgaaccatatggacccaaatcagaaggggtttctagaggagaggccaagtggctcctacaaagcggcatcgtcatcctccttccacatggctacgatggggctgggccagaccactcatcctgtcgaatagagcgtttcctgcagatgtgtgacagtgcggaagagggggtggacggagacactgtgaacatgtttgtggttcacccaacaactcctgcacagtatttccacttgcttaggagacagatggtccggaacttcagaaaaccactca

SEQ ID NO: 125975 - DNA, 482 bp, Homo sapiens
  Payload ID: 4706
  Gene Symbol: DHTKD1
  Gene Name: dehydrogenase E1 and transketolase domain containing 1
  ENST ID: ENST00000415935
  CDS Start-End: 1-482
ggcaggcagcagtctcgccaagacggcgattactctccagacaactcagcccagccgggggacagggtcatttgcttacaggtccatggtgatgcttctttctgtggtcaagggattgttcctgaaacattcacgctgtccaatctcccacatttcagaattggtgggagtgtgcatttgattgttaataaccagctgggttacaccactccagctgaaagaggaaggtcttctttatactgcagtgatattgggaagcttgtgggctgtgccatcatccatgtcaatggagacagcccagaggaagtggtccgtgccacacgactggcttttgaataccaacgccagttccgcaaggatgtgattattgatctgttgtgctacaggcagtggggccacaatgagctggatgagccattctacaccaaccccatcatgtacaaaatcatcaggtacaattataaacccttgtgtgatatgcc

SEQ ID NO: 125976 - DNA, 1480 bp, Homo sapiens
  Payload ID: 4707
  Gene Symbol: DHRS1
  Gene Name: dehydrogenase/reductase (SDR family) member 1
  Uniprot ID: Q96LJ7
  ENST ID: ENST00000288111
  CDS Start-End: 278-1219
tactacgtcatagttccgcgccgccccagccgggcggggtgggtgtgtcacccagatcgctccgcccccatccgcaggttctaactttggcctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaa

SEQ ID NO: 125977 - DNA, 1470 bp, Homo sapiens
  Payload ID: 4707
  Gene Symbol: DHRS1
  Gene Name: dehydrogenase/reductase (SDR family) member 1
  Uniprot ID: Q96LJ7
  ENST ID: ENST00000396813
  CDS Start-End: 270-1211
agatagcccaggactctgcgtggacgcgccccgaggggctgccgcgccagattcccatatccaggcagccacactcagagggttgtagtagttgtccacctctggacagtcccactcagccccttcttcactctctgggcctcccaaaagacagtcagccttgtcctcaggcccgcacccagttgtcagcctctgactcctctcccctcaaaggattcttaccttggctcctcctcttagccctaacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttc

SEQ ID NO: 125978 - DNA, 1623 bp, Homo sapiens
  Payload ID: 4707
  Gene Symbol: DHRS1
  Gene Name: dehydrogenase/reductase (SDR family) member 1
  ENST ID: ENST00000558340
  CDS Start-End: 188-631
cctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcaggaagcctgcagtatatgttcaatgtcccctatggtgtgggcaaagctgcggtgaggacccagtggcataggagctgaggaggtaaaagacagtgatgttacctatagctcaggaggtacaatccccagtggtcagaatggtaaggctggctcctctcagctcctcctctgcctcatccatggacagttcctttgcttgtgctcctcttggttggctagagtaggcatcacactggggagcgtgggcagctgagaccttggggctcctgggaaggacagggtgggtggagcattcacagtagaagcagagagggcagggcaggaaagtgacatggctaggtggctcttaccctgccttccgcctctccacagtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctct

SEQ ID NO: 125979 - DNA, 1341 bp, Homo sapiens
  Payload ID: 4708
  Gene Symbol: DHRS11
  Gene Name: dehydrogenase/reductase (SDR family) member 11
  Uniprot ID: Q6UWP2
  ENST ID: ENST00000611337
  CDS Start-End: 195-740
actctggtgggtctaggcgcggatcggacccaagcaggtcggcggcggcggcaggagagcggccgggcgtcagctcctcgacccccgtgtcgggctagtccagcgagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaa

SEQ ID NO: 125980 - DNA, 756 bp, Homo sapiens
  Payload ID: 4708
  Gene Symbol: DHRS11
  Gene Name: dehydrogenase/reductase (SDR family) member 11
  ENST ID: ENST00000612538
  CDS Start-End: 124-276
ggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaaggtggggcctccctc

SEQ ID NO: 125981 - DNA, 1598 bp, Homo sapiens
  Payload ID: 4708
  Gene Symbol: DHRS11
  Gene Name: dehydrogenase/reductase (SDR family) member 11
  Uniprot ID: Q6UWP2
  ENST ID: ENST00000618403
  CDS Start-End: 213-995
gcggccgggccgcggcggcctccgactggatacggcggatcgccgggggcctgagggtggagtcccggccggaggcaggccgggactctggtgggtctaggcgcggatcggacccaagcaggtcggcggcggcggcaggagagcggccgggcgtcagctcctcgacccccgtgtcgggctagtccagcgaggcggacgggcggcgtgggcccatggccaggcccggcatggagcggtggcgcgaccggctggcgctggtgacgggggcctcggggggcatcggcgcggccgtggcccgggccctggtccagcagggactgaaggtggtgggctgcgcccgcactgtgggcaacatcgaggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctggcccagtggatttcatggtgatcattaaaaaagaaaaatcgcaaccaatc

SEQ ID NO: 125982 - DNA, 926 bp, Homo sapiens
  Payload ID: 4708
  Gene Symbol: DHRS11
  Gene Name: dehydrogenase/reductase (SDR family) member 11
  ENST ID: ENST00000615432
  CDS Start-End: 475-926
tattttcagtagagatagggttccaccaagttagccaaggctggtctcaaactcctgacctcaactggtccacccgccttggccttccaaagtgttgggattacaggcatgagccaccacgcccagccaggacttgagtttatagtgaggtttctccattgataacagccttttcccttcatcactcggggagcactgtcatcccttagactttgaccaaagaggacagacttaggggatgggcagtccaacatcttcgtggctgaaagtcagctgccaaaggagcatgttttatgagtgtgacgggggtcggggtctgaggctggctagggagccgtgggagtgagctgctcaccccagtcagacccctgttgggtttcataggagctggctgctgaatgtaagagtgcaggctaccccgggactttgatcccctacagatgtgacctatcaaatgaagaggacatcctctccatgttctcagctatccgttctcagcacagcggtgtagacatctgcatcaacaatgctggcttggcccggcctgacaccctgctctcaggcagcaccagtggttggaaggacatgttcaatgtgaacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgcatctctccaggtgtggtggagacacaattcgccttcaaactccacgacaaggaccctgagaaggcagctgccacctatgagcaaatgaagtgtctcaaacccga

SEQ ID NO: 125983 - DNA, 883 bp, Homo sapiens
  Payload ID: 4708
  Gene Symbol: DHRS11
  Gene Name: dehydrogenase/reductase (SDR family) member 11
  ENST ID: ENST00000621871
  CDS Start-End: 1-330
aacgtgctggccctcagcatctgcacacgggaagcctaccagtccatgaaggagcggaatgtggacgatgggcacatcattaacatcaatagcatgtctggccaccgagtgttacccctgtctgtgacccacttctatagtgccaccaagtatgccgtcactgcgctgacagagggactgaggcaagagcttcgggaggcccagacccacatccgagccacgtgtctcaaacccgaggatgtggccgaggctgttatctacgtcctcagcacccccgcacacatccagattggagacatccagatgaggcccacggagcaggtgacctagtgactgtgggagctcctccttccctccccacccttcatggcttgcctcctgcctctggattttaggtgttgatttctggatcacgggataccacttcctgtccacaccccgaccaggggctagaaaatttgtttgagatttttatatcatcttgtcaaattgcttcagttgtaaatgtgaaaaatgggctggggaaaggaggtggtgtccctaattgttttacttgttaacttgttcttgtgcccctgggcacttggcctttgtctgctctcagtgtcttccctttgacatgggaaaggagttgtggccaaaatccccatcttcttgcacctcaacgtctgtggctcagggctggggtggcagagggaggccttcaccttatatctgtgttgttatccagggctccagacttcctcctctgcctgccccactgcaccctctcccccttatctatctccttctcggctccccagcccagtcttggcttcttgtcccctcctggggtcatccctccactctgactctgactatggcagcagaacaccagggcctg

SEQ ID NO: 125984 - DNA, 1598 bp, Homo sapiens; identical to SEQ ID NO: 125981
  Payload ID: 4708
  Gene Symbol: DHRS11
  Gene Name: dehydrogenase/reductase (SDR family) member 11
  Uniprot ID: Q6UWP2
  ENST ID: ENST00000621143
  CDS Start-End: 213-995

SEQ ID NO: 125985 - DNA, 883 bp, Homo sapiens; identical to SEQ ID NO: 125983
  Payload ID: 4708
  Gene Symbol: DHRS11
  Gene Name: dehydrogenase/reductase (SDR family) member 11
  ENST ID: ENST00000631945
  CDS Start-End: 1-330

SEQ ID NO: 125986 - DNA, 756 bp, Homo sapiens; identical to SEQ ID NO: 125980
  Payload ID: 4708
  Gene Symbol: DHRS11
  Gene Name: dehydrogenase/reductase (SDR family) member 11
  ENST ID: ENST00000633383
  CDS Start-End: 124-276

SEQ ID NO: 125987 - DNA, 926 bp, Homo sapiens; identical to SEQ ID NO: 125982
  Payload ID: 4708
  Gene Symbol: DHRS11
  Gene Name: dehydrogenase/reductase (SDR family) member 11
  ENST ID: ENST00000632185
  CDS Start-End: 475-926

SEQ ID NO: 125988 - DNA, 1341 bp, Homo sapiens; identical to SEQ ID NO: 125979
  Payload ID: 4708
  Gene Symbol: DHRS11
  Gene Name: dehydrogenase/reductase (SDR family) member 11
  Uniprot ID: Q6UWP2
  ENST ID: ENST00000631686
  CDS Start-End: 195-740

SEQ ID NO: 125989 - DNA, 1970 bp, Homo sapiens
  Payload ID: 4709
  Gene Symbol: DHRS12
  Gene Name: dehydrogenase/reductase (SDR family) member 12
  Uniprot ID: A0PJE2
  ENST ID: ENST00000218981
  CDS Start-End: 113-841
gaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaaggtgacttcctccctggctgtgaaggcagctgacacagggctaggggcagcagctgggccttcgaggcgcaccttcccctccgtgaaacctggggtgggactgtcccctggggggtgcctgggcttctttggcgagatgattgctttgcctgctgaggttagttttgggaagcgcttcactccaggttggtagcttctttggagacttgtgataaccctgtcatcaaggtcctgtgagaacgggagaggcagttcctaccttgggaatggaagattttctctgcagtttgctgaggcccaggaggggcgctattcaaagctgcactgcaaagggagtaacggactctgcttctctgcagtgcaaagggtgtaagggactctgcttctctatttttggaagcagtgatctgttcacgtctctccccagtgggctcctaagggggcaggcgtgtgagtggacgccatccgaagacagcacttgacctcgggtggaagccaggctctttgcttggcttctctttcctctgttcttgatgagaaccacccttgcttgaggaattctgaagcgctggtgacccctggggtatccgggaggatggccgcaccccttcctgctgatcacccaaacgtggtctcccgtccagccctggctgcagcctcccagttcccaaactgcactttacatatcaatccatgctgcctgatccctgtgggacctttgacagcagggatgggggtctaacagctgtagggtgctgccactccagcaggcgtcggttcaaggcctgagcagcacagggacatggacccagccacgctgcagcagctcacacctctctgcggttccctctcacttttagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcaccttg

SEQ ID NO: 125990 - DNA, 1324 bp, Homo sapiens
  Payload ID: 4709
  Gene Symbol: DHRS12
  Gene Name: dehydrogenase/reductase (SDR family) member 12
  Uniprot ID: A0PJE2
  ENST ID: ENST00000280056
  CDS Start-End: 54-869
ccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccagacaggaatgagcaggagctgaggaaggtagtgggagaggcccagactgcctcaccactccccaggtttttggaaataatgatgcatgaaggtaaatgccagccacaaggacacagctcgaatgatctggaagcgtgttggagcagcggtggaggggagcagaattctcttccggattggcctcaccaactccatgacctcaggcagctcacctgggctctctgcagctctttcctcctctacaaacaagggaactgaaagcagcagcagccacagcacacaccccagggtgcacccgcggcgccaagaactggtctcagcgctgtctgcggattaacgcatttgtcctcaagcctctgtggagtggccactactgtctattatcacacccatttacagatgagggaactgaggcccagagaggctaagacctcccagccgggcctggccatggggttttgggaatcaggctctcacacactgctggcatggcctttctgaaaatcactatttatcagaagccttggaattcatcctaagaaataaagatagggaaaacaaggttgcttatcacagtgctggtggtaggagatgaagttaataaattatagaacacctgtgcaaaatctgttcagggctgaagactctgctgccaatcatgcctatggaaaaaccctgtgtgcactatatcattaaatgaagataccaagttc

SEQ ID NO: 125991 - DNA, 1162 bp, Homo sapiens
  Payload ID: 4709
  Gene Symbol: DHRS12
  Gene Name: dehydrogenase/reductase (SDR family) member 12
  Uniprot ID: A0PJE2
  ENST ID: ENST00000444610
  CDS Start-End: 15-968
ggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgggagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcaccttgaa

SEQ ID NO: 125992 - DNA, 487 bp, Homo sapiens
  Payload ID: 4709
  Gene Symbol: DHRS12
  Gene Name: dehydrogenase/reductase (SDR family) member 12
  ENST ID: ENST00000461948
  CDS Start-End: 1-303
agagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagggcgcccacattgtctgtaaggctgccagcaccctccgccttccttgtcgctgctgtgtgccttccgaaggtggccctgtctgagactctctgcacctccacttcttctgtttatatgccctgggtgtgccccagttttgctccttgaccccagaccaaatcctggtgaattacatctcatgactccaaatcctgacatttgaaagacctgcacttctttacagttttcccagaggacatgggaataaaccatccacttgtaaatgag

SEQ ID NO: 125993 - DNA, 1921 bp, Homo sapiens
  Payload ID: 4710
  Gene Symbol: DHRS13
  Gene Name: dehydrogenase/reductase (SDR family) member 13
  Uniprot ID: Q6UX07
  ENST ID: ENST00000378895
  CDS Start-End: 128-1261
cgcctccgccttcggaggctgacgcgcccgggcgccgttccaggcctgtgcagggcggatcggcagccgcctggcggcgatccagggcggtgcggggcctgggcgggagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggcgccaacagcggcatcggaaagatgacggcgctggagctggcgcgccggggagcgcgcgtggtgctggcctgccgcagccaggagcgcggggaggcggctgccttcgacctccgccaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgaa

SEQ ID NO: 125994 - DNA, 2037 bp, Homo sapiens
  Payload ID: 4710
  Gene Symbol: DHRS13
  Gene Name: dehydrogenase/reductase (SDR family) member 13
  Uniprot ID: Q6UX07
  ENST ID: ENST00000394901
  CDS Start-End: 394-1377
cgcctccgccttcggaggctgacgcgcccgggcgccgttccaggcctgtgcagggcggatcggcagccgcctggcggcgatccagggcggtgcggggcctgggcgggagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggtgagtgcggaggcgggtgagtgcgagctggcggggcgcgcggagaggaggccgggccggcggtagcagcggcccgccgggctcagctcagctcggctcccgcccgcggtccgcaggcgccaacagcggcatcggaaagatgacggcgctggagctggcgcgccggggagcgcgcgtggtgctggcctgccgcagccaggagcgcggggaggcggctgccttcgacctccgccaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgaa

SEQ ID NO: 125995 - DNA, 1569 bp, Homo sapiens
  Payload ID: 4710
  Gene Symbol: DHRS13
  Gene Name: dehydrogenase/reductase (SDR family) member 13
  Uniprot ID: Q6UX07
  ENST ID: ENST00000426464
  CDS Start-End: 22-912
gagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgcc

SEQ ID NO: 125996 - DNA, 1705 bp, Homo sapiens
  Payload ID: 4711
  Gene Symbol: DHRS2
  Gene Name: dehydrogenase/reductase (SDR family) member 2
  Uniprot ID: Q13268
  ENST ID: ENST00000250383
  CDS Start-End: 477-1319
aataaaagcaggctgcctgagccggcagcagcaacctgctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaa

SEQ ID NO: 125997 - DNA, 1678 bp, Homo sapiens
  Payload ID: 4711
  Gene Symbol: DHRS2
  Gene Name: dehydrogenase/reductase (SDR family) member 2
  Uniprot ID: Q13268
  ENST ID: ENST00000344777
  CDS Start-End: 439-1341
ctctggttcccttccacgctgtggaagctttgttcttttggtcttcatgataaatcttgctgctgctcactcgttgggtccgtgccacctttaagagctgtaacactcaccgcgaaggtctgcaacttcactcctggggccagcaagaccacgaatgcaccgagaggaatgaacaactctggacacaccatctttaagaaccgtaatactcaccgcaagggtctgcaacttcattcttgaagtcagtgaggccaagaacccatcaattccgtacacattttggtgactttgaagagactgtcacctatcaccaagtggtgagactattgccaagcagtgagactattgccaagtggtgagaccatcaccaagcggtgagactatcacctatcgccaagtggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaa

SEQ ID NO: 125998 - DNA, 834 bp, Homo sapiens
  Payload ID: 4711
  Gene Symbol: DHRS2
  Gene Name: dehydrogenase/reductase (SDR family) member 2
  ENST ID: ENST00000432832
  CDS Start-End: 160-834
agatagaatctgcagtgcctgaaatccagcctgctgcttactcacatcctcatactcagctgcagactgcctgacagaagggctgccaaactgcactccagacagacaggtgcacagccaggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtg

SEQ ID NO: 125999 - DNA, 844 bp, Homo sapiens
  Payload ID: 4711
  Gene Symbol: DHRS2
  Gene Name: dehydrogenase/reductase (SDR family) member 2
  ENST ID: ENST00000553600
  CDS Start-End: 1-486
gagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtgtttcatgggaatgagtctctctggaagaacttcaaggaacatcatcagctgcagaggcaagtggggtttggagatttggtggtccatgtgtggctaggcaggggcagttgagtctattgcaagagcagacccctccctgtcatctggccattgtttttgctgaaatctggagtccacatggccctggagggtgcaagtagccctgctgcatccaccttgttccccatggagcccactcccacctgtcatccgtgagccccagagcagcagaatcagagtacaagatgcttgacactgtgtccttcttccatccaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccagg

SEQ ID NO: 126000 - DNA, 927 bp, Homo sapiens
  Payload ID: 4711
  Gene Symbol: DHRS2
  Gene Name: dehydrogenase/reductase (SDR family) member 2
  ENST ID: ENST00000557535
  CDS Start-End: 1-541
gagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaa

SEQ ID NO: 126001 - DNA, 1287 bp, Homo sapiens
  Payload ID: 4711
  Gene Symbol: DHRS2
  Gene Name: dehydrogenase/reductase (SDR family) member 2
  Uniprot ID: Q13268
  ENST ID: ENST00000611765
  CDS Start-End: 50-952
ctttcccccaggcctgattcagcaggaagcatctcagacaccaaccactatgctgtcagcagttgcccggggctaccagggctggtttcatccctgtgctaggctttctgtgaggatgagcagcaccgggatagacaggaagggcgtcctggctaaccgggtagccgtggtcacggggtccaccagtgggatcggctttgccatcgcccgacgtctggcccgggacggggcccacgtggtcatcagcagccggaagcagcagaacgtggaccgggccatggccaagctgcagggggaggggctgagtgtggcgggcattgtgtgccacgtggggaaggctgaggaccgggagcagctggtggccaaggccctggagcactgtgggggcgtcgacttcctggtgtgcagcgcaggggtcaaccctctggtagggagcactctggggaccagtgagcagatctgggacaagatcctaagtgtgaacgtgaagtccccagccctgctgctgagccagttgctgccctacatggagaacaggaggggtgctgtcatcctggtctcttccattgcagcttataatccagtagtggcgctgggtgtctacaatgtcagcaagacagcgctgctgggtctcactagaacactggcattggagctggcccccaaggacatccgggtaaactgcgtggttccaggaattatcaaaactgacttcagcaaagtggtgaggattggtttcatgggaatgagtctctctggaagaacttcaaggaacatcatcagctgcagaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctggggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctc

SEQ ID NO: 126002 - DNA, 826 bp, Homo sapiens
  Payload ID: 4712
  Gene Symbol: DHRS3
  Gene Name: dehydrogenase/reductase (SDR family) member 3
  ENST ID: ENST00000430996
  CDS Start-End: 384-826
ggaagcggagacagagaccctagaggagaggctgcccccggaggggtgggagctgccagcccccaggggtgctcgaggggagcgaggccgctccagggaggtgggtgcccgccagaggggcggcgagggctgccgggacggttcacgcagcggccagcagactggctgcgtgttgcaatgtctggtggcgtttgcagcatcctgtccgtgtgtgcagctggggtaacctcgggccggcggaggagcgcgtgtggctcgtaggccctgcggccggaggctgctggcaccttgcatctcatttacagctccgggttcagccacagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcag

SEQ ID NO: 126003 - DNA, 539 bp, Homo sapiens
  Payload ID: 4712
  Gene Symbol: DHRS3
  Gene Name: dehydrogenase/reductase (SDR family) member 3
  ENST ID: ENST00000464917
  CDS Start-End: 297-539
gagtgcagggtgtgcgcactcctgggtagagctgggagccgcctgctagctggcgcctcgtattttccttggcaacccgctacccagccccaacctgggcggctgcagctctgaagacacgagagagggtacttggtttgggtttgaaaagggaagagcggtcttgtatgcagtagtctggccggaccgacactgagaggcccaggtgtttggaaagcaggaaagaggaggccaggattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatcca

SEQ ID NO: 126004 - DNA, 1722 bp, Homo sapiens
  Payload ID: 4712
  Gene Symbol: DHRS3
  Gene Name: dehydrogenase/reductase (SDR family) member 3
  Uniprot ID: O75911
  ENST ID: ENST00000616661
  CDS Start-End: 384-1292
tttttttttttttcttcccctccctaaactcctctgtcagtctgtaaacattacctgagaattccccagccgaaacggctgctggggcaagaaacttcttgttagaactttccacctccggcttccccctccacctcttttaccgtcccaaccttaggagacgctttttctcccccagaggagaatttatcttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtga

SEQ ID NO: 126005 - DNA, 1443 bp, Homo sapiens
  Payload ID: 4713
  Gene Symbol: DHRS4
  Gene Name: dehydrogenase/reductase (SDR family) member 4
  Uniprot ID: Q9BTZ2
  ENST ID: ENST00000313250
  CDS Start-End: 204-1040
aaaggcaagccccagtcaggcggaaggtagatggtggaggggcgccgcggcggatggaggtgcccagggccacagaccgctcacagcggtaccggggcggggagcagggcgggcagggaatcggcccgcccttcgtcctgcccctcgccctactctgtcaccgcccctgggaagagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 126006 - DNA, 785 bp, Homo sapiens
  Payload ID: 4713
  Gene Symbol: DHRS4
  Gene Name: dehydrogenase/reductase (SDR family) member 4
  Uniprot ID: Q9BTZ2
  ENST ID: ENST00000397074
  CDS Start-End: 4-480
tccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtg

SEQ ID NO: 126007 - DNA, 727 bp, Homo sapiens
  Payload ID: 4713
  Gene Symbol: DHRS4
  Gene Name: dehydrogenase/reductase (SDR family) member 4
  Uniprot ID: Q9BTZ2
  ENST ID: ENST00000397075
  CDS Start-End: 11-589
ggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatcca

SEQ ID NO: 126008 - DNA, 1340 bp, Homo sapiens
  Payload ID: 4713
  Gene Symbol: DHRS4
  Gene Name: dehydrogenase/reductase (SDR family) member 4
  ENST ID: ENST00000543741
  CDS Start-End: 20-487
atacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagctctggatggacaaggaaaaagaggaaagcatgaaagaaaccctgcggataagaaggtaaactgtcatgagggcaagggcactaagagacatgaagatgggaaggtctggtccctagcagcccacagcccgctgtctcagtcccacagataacacaggcaggctctcttctgcctcacagaccacgaattcataaacactatcactacagtgacctgagcaagaagtcagcttccctttcaaaaggtaaacacagagacatcggggtttcagcagtgcagagctctgggagaagccctgagtcctctctccacctgggggattgcctccacctctgagcatccatggagaccagggaccataaccaaaaccatgctttgttagtccccttgaataatgacacatgtttacaaaactcaggttgatgatctacaatccaaatgaaaagaatgaagagttttactaagccccaaactccccttgcctaaggagttactttcttccccagtgagctgggtgaactgttcaagcacctttgtcgggctccctttcctctaagttccctgcctctctctaccttctggcttcaaggacaaatgccagtaatgcctaactctgtactcgtccagacatcccaaatcttcccaaagccattctgatgtgagacatgagctgcaggcctggttcataactcattaataagtgaggggattgtcaacctagagcaccaatgaatgatctagcccatgtagctcaatactggattcacattagaatcacctggggagctttttaaactgcaggtgctcaggccccacccactcccagagattctttttaattggtccaaggtaggacttgaccatctgggcttttgtttttctttgtcttttcttttcttttcttttttggtt

SEQ ID NO: 126009 - DNA, 1143 bp, Homo sapiens
  Payload ID: 4713
  Gene Symbol: DHRS4
  Gene Name: dehydrogenase/reductase (SDR family) member 4
  Uniprot ID: Q9BTZ2
  ENST ID: ENST00000558581
  CDS Start-End: 1-735
atgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacgactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaatccaa

SEQ ID NO: 126010 - DNA, 1089 bp, Homo sapiens
  Payload ID: 4713
  Gene Symbol: DHRS4
  Gene Name: dehydrogenase/reductase (SDR family) member 4
  Uniprot ID: Q9BTZ2
  ENST ID: ENST00000558263
  CDS Start-End: 56-622
cctactctgtcaccgcccctgggaagagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagaggcggctcagtggtgatcgtgtcttccatagcagccttcagtccatctcctctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 126011 - DNA, 1003 bp, Homo sapiens
  Payload ID: 4713
  Gene Symbol: DHRS4
  Gene Name: dehydrogenase/reductase (SDR family) member 4
  Uniprot ID: Q9BTZ2
  ENST ID: ENST00000559632
  CDS Start-End: 1-600
atgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacgactctggacattaatgtgaaggccccagccctgatgacaaaggcagtggtgccagaaatggagaaacgaggaggcggctcagtggtgatcgtgtcttccatagcagccttcagtccatctcctctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 126012 - DNA, 699 bp, Homo sapiens
  Payload ID: 4713
  Gene Symbol: DHRS4
  Gene Name: dehydrogenase/reductase (SDR family) member 4
  ENST ID: ENST00000559975
  CDS Start-End: 1-186
aggaacattagggtgaactgcctagcacctggacttatcaagactagcttcagcaggatgctctggatggacaaggaaaaagaggaaagcatgaaagaaaccctgcggataagaagaccacgaattcataaacactatcactacagtgacctgagcaagaagtcagcttccctttcaaaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaa

SEQ ID NO: 126013 - DNA, 1370 bp, Homo sapiens
  Payload ID: 4714
  Gene Symbol: DHRS4L2
  Gene Name: dehydrogenase/reductase (SDR family) member 4 like 2
  Uniprot ID: Q6PKH6
  ENST ID: ENST00000335125
  CDS Start-End: 127-825
gactcccagctggccgagggcgggaagggggcaggcagggaagcggcccgcccttcgtcctgccccttcgccctactctgtcacctccgctggaaggagtggaacccagacttgctggtctgatccatgcagatggccaggctgctaggcctctgtgcctgggcacggaagtcggtgcggatggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatccaa

SEQ ID NO: 126014 - DNA, 1234 bp, Homo sapiens
  Payload ID: 4714
  Gene Symbol: DHRS4L2
  Gene Name: dehydrogenase/reductase (SDR family) member 4 like 2
  ENST ID: ENST00000382755
  CDS Start-End: 3-833
ccatgcagatggccaggctgctaggcctctgtgcctgggcacggaagtcggtgcggatggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttg

SEQ ID NO: 126015 - DNA, 1117 bp, Homo sapiens
  Payload ID: 4714
  Gene Symbol: DHRS4L2
  Gene Name: dehydrogenase/reductase (SDR family) member 4 like 2
  ENST ID: ENST00000397071
  CDS Start-End: 131-709
agacgactcccagctggccgagggcgggaagggggcaggcagggaagcggcccgcccttcgtcctgccccttcgccctactctgtcacctccgctggaaggagtggaacccagacttgctggtctgatccatgcagatggccaggctgctaggcctctgtgcctgggcacggaagtcggtgcggatggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatccaa

SEQ ID NO: 126016 - DNA, 918 bp, Homo sapiens
  Payload ID: 4714
  Gene Symbol: DHRS4L2
  Gene Name: dehydrogenase/reductase (SDR family) member 4 like 2
  ENST ID: ENST00000537912
  CDS Start-End: 61-534
ttcgccctactctgtcacctccgctggaaggagtggaacccagacttgctggtctgatccatgcagatggccaggctgctaggcctctgtgcctgggcacggaagtcggtgcggatggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatgggcttcagtccttacaatgtcagtaaaacagccttgctgggcctcaacaataccctggccatagagctggccccaaggaacattagggtgaactgcctgcacctggacttatcaagactagcttcagcaggatgctctggatggacaaggaaaaagaggaaagcatgaaagaaaccctgcggataagaaggtaaactgtcatgagggcaagggcactaagagacatgaagatgggaaggtctggtccctagcagcccacagcccgctgtctcagtcccacagataacacaggcaggctctcttctgcctcacagaccacgaattcataaacactatcactacagtgacctgagcaagaagtcagcttccctttccaaaggtaaacacagagacatcggggtttcagcagtgcagaggtctcggagaagccctgagtcctctctccacctgggggattgcctccacctctgagcatccatggagaccagggaccataaccaaaaccatgctttgttagtccccttgaataatgacacatgtttacaaaactca

SEQ ID NO: 126017 - DNA, 1450 bp, Homo sapiens
  Payload ID: 4714
  Gene Symbol: DHRS4L2
  Gene Name: dehydrogenase/reductase (SDR family) member 4 like 2
  ENST ID: ENST00000534993
  CDS Start-End: 635-907
atgctcagtcgggcagctctccgggccggcgtgggagcccgcgctccaaggcccggtggggggaggggcgctcacgcaaccgccactgtctggagcgggctcgcctctgcggcagccctcaccgcccgggctttactgaagcggagtctagcatgtgcggctgctccacagcggtgtgggtggcggcggctcctctgcagcagcctcggcagtaggggtcagggtggccaagcccaccgtggagctcatctgagagttgtaaggtacgggactgcctcggtctttgggacgccccgtctggtagcatcccagatccagcacgttccttccggccctgcaccccggcccggtgcctcacaccccgctaccccaagcatccagactctaaggcagcccctgcatctcagtcctgacatcgctgtccctggagcatcctccgctggagctggagcttgacaggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagggcttcagtccttacaatgtcagtaaaacagccttgctgggcctcaacaataccctggccatagagctggccccaaggaacattagggtgaactgcctgcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatcc

SEQ ID NO: 126018 - DNA, 1334 bp, Homo sapiens
  Payload ID: 4714
  Gene Symbol: DHRS4L2
  Gene Name: dehydrogenase/reductase (SDR family) member 4 like 2
  ENST ID: ENST00000543805
  CDS Start-End: 402-818
ccaccgtggagctcatctgagagttgtaaggtacgggactgcctcggtctttgggacgccccgtctggtagcatcccagatccagcacgttccttccggccctgcaccccggcccggtgcctcacaccccgctaccccaagcatccagactctaaggcagcccctgcatctcagtcctgacatcgctgtccctggagcatcctccgctggagctggagcttgacaggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgggacttatcaagactagcttcagcaggatgctctggatggacaaggaaaaagaggaaagcatgaaagaaaccctgcggatagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatcc

SEQ ID NO: 126019 - DNA, 413 bp, Homo sapiens
  Payload ID: 4714
  Gene Symbol: DHRS4L2
  Gene Name: dehydrogenase/reductase (SDR family) member 4 like 2
  ENST ID: ENST00000560276
  CDS Start-End: 1-328
aagcctaatggatgtcaccgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagcta

SEQ ID NO: 126020 - DNA, 574 bp, Homo sapiens
  Payload ID: 4714
  Gene Symbol: DHRS4L2
  Gene Name: dehydrogenase/reductase (SDR family) member 4 like 2
  ENST ID: ENST00000559387
  CDS Start-End: 429-574
gatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatgagccttacacaggttatctctagacctgacaacaacccaagcaaggcaaggactattctctcagtctgcagaccctggctcagatagctggagcaacttcccaaggtcccacagccagtaaggaaagacccagacctcccaagctcccttcctttattggctgcctgtggactaccaggctgtgaagcttcatggaggtatcgatatcctagtctccaatgctgctgtcaaccctttctttggaagcctaatggatgtcaccgaggaggtgtgggacaagactctggacattaatgtgaaggccccagccctgatgacaaaggcagtggtgccagaaatggagaaacgaggaggcggctcagtggtgatcgtgtcttccatagcagccttcagtcc

SEQ ID NO: 126021 - DNA, 556 bp, Homo sapiens
  Payload ID: 4714
  Gene Symbol: DHRS4L2
  Gene Name: dehydrogenase/reductase (SDR family) member 4 like 2
  ENST ID: ENST00000558753
  CDS Start-End: 61-534
ttcgccctactctgtcacctccgctggaaggagtggaacccagacttgctggtctgatccatgcagatggccaggctgctaggcctctgtgcctgggcacggaagtcggtgcggatggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatgggcttcagtccttacaatgtcagtaaaacagccttgctgggcctcaacaataccctggccatagagctggccccaaggaacattagggtgaactgcctgcacctggacttatcaagactagcttcagcaggatgctctggatggacaaggaaaaagaggaaagcatgaaagaaaccctgcggataagaag

SEQ ID NO: 126022 - DNA, 854 bp, Homo sapiens
  Payload ID: 4714
  Gene Symbol: DHRS4L2
  Gene Name: dehydrogenase/reductase (SDR family) member 4 like 2
  ENST ID: ENST00000559411
  CDS Start-End: 127-854
gactcccagctggccgagggcgggaagggggcaggcagggaagcggcccgcccttcgtcctgccccttcgccctactctgtcacctccgctggaaggagtggaacccagacttgctggtctgatccatgcagatggccaggctgctaggcctctgtgcctgggcacggaagtcggtgcggatggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgcacctggacttatcaagactagcttcagcaggatggttaggcgagccagaggattgtgctggcatcgtgtctttcctgtgctctgaagatgccagcta

SEQ ID NO: 126023 - DNA, 1049 bp, Homo sapiens
  Payload ID: 4714
  Gene Symbol: DHRS4L2
  Gene Name: dehydrogenase/reductase (SDR family) member 4 like 2
  ENST ID: ENST00000621761
  CDS Start-End: 1-648
atgccattcccctgcctcagcctcccgagtagctgggactacaggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatgactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgcctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttg

SEQ ID NO: 126024 - DNA, 2322 bp, Homo sapiens
  Payload ID: 4715
  Gene Symbol: DHRS7
  Gene Name: dehydrogenase/reductase (SDR family) member 7
  Uniprot ID: Q9Y394
  ENST ID: ENST00000216500
  CDS Start-End: 457-1476
gcaatccaagactgcttagggttcggaattacaaaaccaaattccctgctaaggctaaagttgatctgaacaaaagtaagggcaaggcaaagagaatagacattagacagggacctgaaaggatccagaaatgggactttacatcccacagaggaaacagacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgcaaaaaaggtattaactcatactatattcttggataaaataaccttttaaaatactttagcacatatgcttaaaatctaagttaacagatttgtcttagtccatttgtgctgctataacaaaataccacagatttggtaatttataaacaacagaaatctgtttttcctggctcttgaggctgggaattccaagaccaatgcaccagcagaattagtgtctggtgaaggctgatctctgcttccaagatggcacctcattgctgcatcctccacagtggaggaatgtatgtcctcacatggtggaagggacagaagggaaagaggagcaaaatgctttcaaaagagcatttaatctcattcattactcagtcacctcttaaaggccacatcctttaatactgttgctttggggattaagtttcgacatgaattttggaggggacaaaaacatccaaaccatagcaacataaatgtatagaatatttcacacaaagcagagtgctgggtaatgaccagatataaagaagtatttgaaatgaccttacctccaagatgcttatactcttagaaaagttgacaggtacagatggctgtaatttgaagcagcaggtaggattcattgcacctattattcattaaacacctgttgtatgtcttctactgt

SEQ ID NO: 126025 - DNA, 1194 bp, Homo sapiens
  Payload ID: 4715
  Gene Symbol: DHRS7
  Gene Name: dehydrogenase/reductase (SDR family) member 7
  Uniprot ID: Q9Y394
  ENST ID: ENST00000536410
  CDS Start-End: 165-1034
gcttagggttcggaattacaaaaccaaattccctgctaaggctaaagttgatctgaacaaaagtaagggcaaggcaaagagaatagacattagacagggacctgaaaggatccagaaatgggactttacatcccacagaggaaacagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataat

SEQ ID NO: 126026 - DNA, 1361 bp, Homo sapiens
  Payload ID: 4715
  Gene Symbol: DHRS7
  Gene Name: dehydrogenase/reductase (SDR family) member 7
  ENST ID: ENST00000554101
  CDS Start-End: 1-1199
tgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggtaagaccaatttctaagtttcttaatagtatgtaccaatcttgcaggaaggtacagaattttccagtgtttaaaaaactttctggctgggtgcagtggctcatgtctgtaatcccagcactttgggaggccaaggcagatcacttgaggccaggagttcaagaccaacctggccaacatagtgaaaccccatctctactaaaaatacaaaaagtagctgggcatggtggtgcatgcctgtaatcccagctactcgggaggctgaggcatgagaattgcttgaaccgaggaggcggaggttgcagtgagccaggatggtgccactgcactccagcccgggtgatagagcgagactctatttcaaaatcaaaaaacctttctaaccctccaccaatctcatgatat

SEQ ID NO: 126027 - DNA, 480 bp, Homo sapiens
  Payload ID: 4715
  Gene Symbol: DHRS7
  Gene Name: dehydrogenase/reductase (SDR family) member 7
  ENST ID: ENST00000557137
  CDS Start-End: 1-480
tgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaggtttttttaatggccttcgaacagaacttgccacatacccaggtataatagtttctaacatttgcccaggacctgtgcaatcaaata

SEQ ID NO: 126028 - DNA, 1322 bp, Homo sapiens
  Payload ID: 4715
  Gene Symbol: DHRS7
  Gene Name: dehydrogenase/reductase (SDR family) member 7
  Uniprot ID: Q9Y394
  ENST ID: ENST00000557185
  CDS Start-End: 121-1140
ggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccaacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgc

SEQ ID NO: 126029 - DNA, 686 bp, Homo sapiens
  Payload ID: 4715
  Gene Symbol: DHRS7
  Gene Name: dehydrogenase/reductase (SDR family) member 7
  ENST ID: ENST00000557751
  CDS Start-End: 1-638
acattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataat

SEQ ID NO: 126030 - DNA, 582 bp, Homo sapiens
  Payload ID: 4715
  Gene Symbol: DHRS7
  Gene Name: dehydrogenase/reductase (SDR family) member 7
  ENST ID: ENST00000557326
  CDS Start-End: 400-582
atgcactctaactgggtccctctgaggcttgtgaatggaaaaccctcttgctttcaaatgcttgaaaacaagaaagatgctactattgatgcctcaaatacatacacagggtttcctcatgttgcccaggctggtctcggacacttgaattcaagcaatctgccggccccgccgggtgtgccgcatgagggcgcgggccgcccaaggaccgcgagtggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtgga

SEQ ID NO: 126031 - DNA, 1321 bp, Homo sapiens
  Payload ID: 4715
  Gene Symbol: DHRS7
  Gene Name: dehydrogenase/reductase (SDR family) member 7
  ENST ID: ENST00000611054
  CDS Start-End: 121-1251
ggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagaagagtgcatgagctggaaagggtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaaagctaatagagcttaactacttagggacggtgtccttgacaaaatgtgttctgcctcacatgatcgagaggaagcaaggaaagattgttactgtgaatagcatcctgggtatcatatctgtacctctttccattggatactgtgctagcaagcatgctctccggggtttttttaatggccttcgaacagaacttgccacatacccaggtataatagtttctaacatttgcccaggacctgtgcaatcaaatattgtggagaattccctagctggagaagtcacaaagactataggcaataatggagaccagtcccacaagatgacaaccagtcgttgtgtgcggctgatgttaatcagcatggccaatgatttgaaagaagtttggatctcagaacaacctttcttgttagtaacatatttgtggcaatacatgccaacctgggcctggtggataaccacaagatggggaagaaaaggattgagaactttaagagtggtgtggatgcagactcttcttattttaaaatctttaagacaaaacatgactgaaaagagcacctgtacttttcaagccactggagggagaaatggaaaacatgaaaacagcaatcttcttatgcttctgaataatcaaagactaatttgtgattttactttttaatagatatgactttgcttccaacatggaatgaaataaaaaataaataataaaagattgccatgaatcttgc

SEQ ID NO: 126032 - DNA, 2175 bp, Homo sapiens
  Payload ID: 4716
  Gene Symbol: DHRS7B
  Gene Name: dehydrogenase/reductase (SDR family) member 7B
  Uniprot ID: Q6IAN0
  ENST ID: ENST00000395511
  CDS Start-End: 321-1298
acctttgtgccagttatcacactgttctgattactgtggcattataatcatcttgataactgtatcgtgaattctccaactgtgttcttcgccggaagtccacggaacaccaaccacgaccttcggaatttccctccggaagatgaaggcactgtagttatgcgggtggaccctatcagatctcgggtccatcgggtcctgtgtacaccttgagggacgcccacccaacgcgcatgcgcagcctcaatgctgggattggacggagcctcgccggctgcgtacacgtcacttccgaggcgggaggatgaagttgattgactatggtctctccggctaccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagtaagagttgtagtcttccaggactagaaccttgtgtcctttgaattctcgccctgccagctcctagaaatagtttcaatcttggaatcagatgttatgtcacctgacccagttgtttctgtatttgacttaaacctcattgttgtggcagaaagaccacctccagtactgaggggagaaagttgtagtttcaagaagtcagcagtcacgcccatttccaggtccctatgatatctcatccaacttaaaacgtgggccagtatgtaatggcttatttggtgtatcccaagggatgcctgctttagcacctcataggaattcctgtttctctcttaactctcaccacatccctgtaggatgccaggcaccactccaagcagaaggtgaacttactaaagagagagcagccaaaagggagaggaggaccctgcgtggccccgtgcatcctctagaagtgaaaccattaaattggccagctgggcagactctacagcagcccctggtctggtggaagtgagccatttgttagctctaactagttggatcatagccagaaagaatgcctgtttctgcctttctgatttattaaaaatacattgttgaggctcactgaa

SEQ ID NO: 126033 - DNA, 668 bp, Homo sapiens
  Payload ID: 4716
  Gene Symbol: DHRS7B
  Gene Name: dehydrogenase/reductase (SDR family) member 7B
  ENST ID: ENST00000583388
  CDS Start-End: 1-376
catcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagtaagagttgtagtcttccaggactagaa

SEQ ID NO: 126034 - DNA, 767 bp, Homo sapiens
  Payload ID: 4716
  Gene Symbol: DHRS7B
  Gene Name: dehydrogenase/reductase (SDR family) member 7B
  ENST ID: ENST00000582161
  CDS Start-End: 389-767
aacaacccttgatgctgttgcagaaatcataggttgtgacacccacagcattctctcaaccatctacacattcctccaagattatcacactgttctgattactgtggcattataatcatcttgataactgtatcgtgaattctccaactgtgttcttcgccggaagtccacggaacaccaaccacgaccttcggaatttccctccggaagatgaaggcactgtagttatgcgggtggaccctatcagatctcgggtccatcgggtcctgtgtacaccttgagggacgcccacccaacgcgcatgcgcagcctcaatgctgggattggacggagcctcgccggctgcgtacacgtcacttccgaggcgggaggatgaagttgattgactatggtctctccggctaccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcag

SEQ ID NO: 126035 - DNA, 729 bp, Homo sapiens
  Payload ID: 4716
  Gene Symbol: DHRS7B
  Gene Name: dehydrogenase/reductase (SDR family) member 7B
  ENST ID: ENST00000581463
  CDS Start-End: 1-324
atgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggaggtaaattgtcaacctccctcctgacatggaagagaagggtctccttagtgttcacactggagacagtagacccaggcaagagctggaactgagacagcagcagcacctgtctaaagctcagcccgagtctaaggttgaatgaaagtgccgagcacacagcaggtttccaggaaatggcagcaatgaagggcgctctccctttagatggaaatgagaggacatttctccttggatgctgttggctgccacactcagagacacctggtgtccaggtgctgtcctttcctctccattatataacatggttagcaactggaggttgatgtgataggctgccctcaaaggaatgcaggtttaccaactgtgtactccgtcatcagaagatgggaacatcacatatgttgctgaggtttttggttttggggccgttgtgttctgactcacagctggggtgcatggagcttgggctagcattaaagagtgcttaacctacatac

SEQ ID NO: 126036 - DNA, 998 bp, Homo sapiens
  Payload ID: 4716
  Gene Symbol: DHRS7B
  Gene Name: dehydrogenase/reductase (SDR family) member 7B
  ENST ID: ENST00000578426
  CDS Start-End: 18-290
gatgaagttgattgactatggtctctccggctaccaggaagagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtggga

SEQ ID NO: 126037 - DNA, 1479 bp, Homo sapiens
  Payload ID: 4716
  Gene Symbol: DHRS7B
  Gene Name: dehydrogenase/reductase (SDR family) member 7B
  ENST ID: ENST00000579303
  CDS Start-End: 255-1187
gattgactatggtctctccggctaccaggtaggggctggggaagaaggaacctccgagatgaggcgatagggtctggccttgagctgaggcgacgccccggcttgggtgaggggaagcggtgtagtggtcgagctaaggccgcgggccctgggcggcttccggatccccgcgacgccgaactctgaaggaagactcagcccaggcgctgggaccagagccctggctccggcgaagtctgccgaaggtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaagcactcctgccctccatgatcaagaggaggcaaggccacattgtcgccatcagcagcatccagggcaagatgagcattccttttcgatcagcatatgcagcctccaagcacgcaacccaggctttctttgactgtctgcgtgccgagatggaacagtatgaaattgaggtgaccgtcatcagccccggctacatccacaccaacctctctgtaaatgccatcaccgcggatggatctaggtatggagttatggacaccaccacagcccagggccgaagccctgtggaggtggcccaggatgttcttgctgctgtggggaagaagaagaaagatgtgatcctggctgacttactgccttccttggctgtttatcttcgaactctggctcctgggctcttcttcagcctcatggcctccagggccagaaaagagcggaaatccaagaactcctagtactctgaccagccagggccagggcagagaagcagcactcttaggcttgcttactctacaagggacagttgcatttgttgagactttaatggagatttgtctcacaagtgggaaagactgaagaaacacatctcgtgcagatctgctggcagaggacaatcaaaaacgacaacaagcttcttcccagggtgaggggaaacacttaaggaataaatatggagctggggtttaacactaaaaactagaaataaacatctcaaacagtaagagttgtagtcttccaggactagaa

SEQ ID NO: 126038 - DNA, 1006 bp, Homo sapiens
  Payload ID: 4717
  Gene Symbol: DHRS7C
  Gene Name: dehydrogenase/reductase (SDR family) member 7C
  Uniprot ID: A6NNS2
  ENST ID: ENST00000330255
  CDS Start-End: 14-952
cccccagaacaagatgggagtcatggccatgctgatgctccccctgctgctgctgggaatcagcggcctcctcttcatttaccaagaggtgtccaggctgtggtcaaagtcagctgtgcagaacaaagtggtggtgatcaccgatgccatctcaggactgggcaaggagtgtgctcgggtgttccacacaggtggggcaaggctggtgctgtgtggaaagaactgggagaggctagagaacctatatgatgccttgatcagcgtggctgaccccagcaagcagacattcaccccaaagctggtcctgttggacctctcagacatcagctgtgtcccagatgtggcaaaagaagtcctggattgctatggctgtgtggacatcctcatcaacaatgccagtgtgaaggtgaaggggcctgcccataagatttctctggagctcgacaaaaagatcatggatgccaattactttggccccatcacattgacgaaagccctgcttcccaacatgatctcccggagaacaggccaaatcgtgttagtgaataatatccaagggaagtttggaatcccgttccgtacgacttacgctgcctccaagcacgcagccctgggcttctttgactgcctccgagccgaagtggaggaatacgatgttgtcatcagcaccgtgagcccgactttcatccggtcgtaccacgtgtatccagagcaaggaaactgggaagcttccatttggaaattctttttcaggaagctgacctacggcgtgcacccagtagaggtggcggaggaggtgatgcgcaccgtgcggaggaagaagcaagaggtgtttatggccaaccccatccccaaggccgccgtgtacgtccgcaccttcttcccggagttctttttcgccgtggtggcctgtggggtgaaggagaagctcaatgtcccggaggaggggtaactgcaggaggccaaatgggccaccccttggaaataaaggtttttctggcaggtg

SEQ ID NO: 126039 - DNA, 984 bp, Homo sapiens
  Payload ID: 4717
  Gene Symbol: DHRS7C
  Gene Name: dehydrogenase/reductase (SDR family) member 7C
  Uniprot ID: A6NNS2
  ENST ID: ENST00000571134
  CDS Start-End: 14-949
cccccagaacaagatgggagtcatggccatgctgatgctccccctgctgctgctgggaatcagcggcctcctcttcatttaccaagaggtgtccaggctgtggtcaaagtcagctgtgcagaacaaagtggtggtgatcaccgatgccatctcaggactgggcaaggagtgtgctcgggtgttccacacaggtggggcaaggctggtgctgtgtggaaagaactgggagaggctagagaacctatatgatgccttgatcagcgtggctgaccccagcaagacattcaccccaaagctggtcctgttggacctctcagacatcagctgtgtcccagatgtggcaaaagaagtcctggattgctatggctgtgtggacatcctcatcaacaatgccagtgtgaaggtgaaggggcctgcccataagatttctctggagctcgacaaaaagatcatggatgccaattactttggccccatcacattgacgaaagccctgcttcccaacatgatctcccggagaacaggccaaatcgtgttagtgaataatatccaagggaagtttggaatcccgttccgtacgacttacgctgcctccaagcacgcagccctgggcttctttgactgcctccgagccgaagtggaggaatacgatgttgtcatcagcaccgtgagcccgactttcatccggtcgtaccacgtgtatccagagcaaggaaactgggaagcttccatttggaaattctttttcaggaagctgacctacggcgtgcacccagtagaggtggcggaggaggtgatgcgcaccgtgcggaggaagaagcaagaggtgtttatggccaaccccatccccaaggccgccgtgtacgtccgcaccttcttcccggagttctttttcgccgtggtggcctgtggggtgaaggagaagctcaatgtcccggaggaggggtaactgcaggaggccaaatgggccaccccttggaaata

SEQ ID NO: 126040 - DNA, 453 bp, Homo sapiens
  Payload ID: 4717
  Gene Symbol: DHRS7C
  Gene Name: dehydrogenase/reductase (SDR family) member 7C
  ENST ID: ENST00000571771
  CDS Start-End: 1-399
agtgtgaaggtgaaggggcctgcccataagatttctctggagctcgacaaaaagatcatggatgccaattactttggccccatcacattgacgaaagccctgcttcccaacatgatctcccggagaacaggccaaatcgtgttagtgaataatatccaagggaagtttggaatcccgttccgtacgactttctttttcaggaagctgacctacggcgtgcacccagtagaggtggcggaggaggtgatgcgcaccgtgcggaggaagaagcaagaggtgtttatggccaaccccatccccaaggccgccgtgtacgtccgcaccttcttcccggagttctttttcgccgtggtggcctgtggggtgaaggagaagctcaatgtcccggaggaggggtaactgcaggaggccaaatgggccaccccttggaaataaaggtttttctggcaggtg

SEQ ID NO: 126041 - DNA, 1917 bp, Homo sapiens
  Payload ID: 4718
  Gene Symbol: DHRS9
  Gene Name: dehydrogenase/reductase (SDR family) member 9
  Uniprot ID: Q9BPW9
  ENST ID: ENST00000357546
  CDS Start-End: 558-1517
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 126042 - DNA, 1044 bp, Homo sapiens
  Payload ID: 4718
  Gene Symbol: DHRS9
  Gene Name: dehydrogenase/reductase (SDR family) member 9
  Uniprot ID: Q9BPW9
  ENST ID: ENST00000421653
  CDS Start-End: 526-1044
cggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtga

SEQ ID NO: 126043 - DNA, 1678 bp, Homo sapiens
  Payload ID: 4718
  Gene Symbol: DHRS9
  Gene Name: dehydrogenase/reductase (SDR family) member 9
  Uniprot ID: Q9BPW9
  ENST ID: ENST00000428522
  CDS Start-End: 324-1283
atgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataagtttgaagataattgggagtctgacagaacaattaaaattgaattattgtttctaatagattttaagcccattctgcagtggaatttcatgaactagcaagaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaa

SEQ ID NO: 126044 - DNA, 1652 bp, Homo sapiens
  Payload ID: 4718
  Gene Symbol: DHRS9
  Gene Name: dehydrogenase/reductase (SDR family) member 9
  Uniprot ID: Q9BPW9
  ENST ID: ENST00000432060
  CDS Start-End: 113-1252
aggaagaaaatataaagtacacttttaaaacatgaagtcttcatagcagcttatagtcgttcagagaaacatgttccactgagaatgacttgagagagaggattacatcattatgccagaaggaagaagccactgtgcatgctctatcaccagcctcaccctcctggtcagccttacaagagtgacactggatatactccagaagttggacccaccacagcctgcacactggagacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 126045 - DNA, 524 bp, Homo sapiens
  Payload ID: 4718
  Gene Symbol: DHRS9
  Gene Name: dehydrogenase/reductase (SDR family) member 9
  ENST ID: ENST00000450153
  CDS Start-End: 327-524
tactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggaaaacaaactcaggaagaaaaagaaaagcagaagtgatcaaggagagcgctcgagttgcaatattttcctttggctgctgacaggcagttactataaagcattgtgcatggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatca

SEQ ID NO: 126046 - DNA, 1817 bp, Homo sapiens
  Payload ID: 4718
  Gene Symbol: DHRS9
  Gene Name: dehydrogenase/reductase (SDR family) member 9
  Uniprot ID: Q9BPW9
  ENST ID: ENST00000436483
  CDS Start-End: 458-1417
atttatttttaagaaacagaggaaggtgaataagagaagtgaaattaaataatcctattttaacttttttactaggaaaacaaactcaggaagaaaaagaaaagcagaagtgatcaaggagagcgctcgagttgcaatattttcctttggctgctgacaggcagttactataaagcattgtgcatggtaggaaaatggaggctaagaaaagttaatttgtccgagggccctctgatgatagtgaaactgggatggaacctctgcctgcttgcttctgaggtctgggctcctaactactgctctactgcctcgagccaagagatttacgccctattaagcaatttgttgtgcgataaattggaagacacagcagataagcaaacaactcaagcaaccaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 126047 - DNA, 1465 bp, Homo sapiens
  Payload ID: 4718
  Gene Symbol: DHRS9
  Gene Name: dehydrogenase/reductase (SDR family) member 9
  Uniprot ID: Q9BPW9
  ENST ID: ENST00000412271
  CDS Start-End: 106-1065
agattttaagcccattctgcagtggaatttcatgaactagcaagaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 126048 - DNA, 2863 bp, Homo sapiens
  Payload ID: 4718
  Gene Symbol: DHRS9
  Gene Name: dehydrogenase/reductase (SDR family) member 9
  Uniprot ID: Q9BPW9
  ENST ID: ENST00000602501
  CDS Start-End: 1504-2463
atctgaaaaattaataattccttaattatcaaatatccattatttaaatttataattgtgtcataaatattgtcataaatagatttgctgttttaaagcttgttccttcattttctctgttttgttttagataaacattgtcataaatagatttgttgttttaaagcttgttccttcattttctctgattgttttgttttagattcagaggttacttatgcttgtttgttacatggatgttacatgtgtaatgggggatattggacttctagtgtactcatcacccatatactgaacactgtactcaaaagggattgaaagaaactaggaaacttggcaggaagatcattcttaagccaggaaaaaaatttttaatgctcacatgtgaacatgtgatggtcataccagaaggagcacccacctccctccctctgtgacagacacattttcttagccttcacctttccttctttcaagttgctgaaaatccacagtgtttctgttcatttgttactttcattctcacctatcttctctcttgctccatctaccagaacaataattccccatataatacttctcacttcacttttcaacgcaggacctcttgttggtctgatctgtttgtctgtccgctttatcaatattatcagatgtaagtttacatgaatacacacacatattcactaaactgaggggaaaaaatgccttgtaggtcataaaaaagcagggaaattcccaacaattcatatttgatccctggatccaggggtggcagcaataagcctgctttagatatttactccccattttatgatccggtggtttggtttttcaaatgatgatatggctcctttcgcaatgacttgatgtttaggaggtgtgcttcaataaatacattttaaaatcaacaatcaagttagagttgtacaaatggctctgaaatgtcccactacactgttagaccaagggcacagattgtgcttctgtactatttatcctagtatccctcggcatatattaactgctctaaaaatctccttggctacacgctgcatcaaatcaaagttaaatgttataccacctttctattctatttttaatattcaaagagggtgctcagattttagaacaaatttcaatgtttaagtacacacaaaaaaatcattaactcatatatttcaagagtaggaaatgggaactggtgttaaaactcttataacaaatgtcactgtcttaagggacagtgtttaaaaacgcatacctggccgggcgcggtggctcatgcctgtaatcccagcactttgggaggccgaggccggcggatcacaaggaaaacaaactcaggaagaaaaagaaaagcagaagtgatcaaggagagcgctcgagttgcaatattttcctttggctgctgacaggcagttactataaagcattgtgcatggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 126049 - DNA, 2571 bp, Homo sapiens
  Payload ID: 4719
  Gene Symbol: DHRSX
  Gene Name: dehydrogenase/reductase (SDR family) X-linked
  Uniprot ID: Q8N5I4
  ENST ID: ENST00000334651
  CDS Start-End: 54-1046
gcgcagagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacccgtctggcgaagaagcttctcggctggttgcttttcaagacccccgatgaaggagcgtggacttccatctacgcagcagtcaccccagagctggaaggagttggtggccattacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacataaatgtgccattttccttgccgcgttaatacaactgagtacaaaagttccaagagagatgctctcttttcaggggctgcaatgtcctctctgagacctagtggtggatgaggtctcctgtttgattttgttcctgcactcactcatttttccagagacccagctgtgattcacaggtgtcagacatggggaggtgtgagccttgcttgctacagcctgtaggatgagtttgacgtggccagcagcaccatctggtcaacctcattccagaatggcacagtcacaagtgaagcatgccactgtcaaatccgagaatgtaaaccgctgaacagctatggatcaaatggtagccctcaaaagatatgttcatgccctaaccctcagaacctataaatattactttatttggaaaagaatctttgcagatagaattaagaattttgagatgggtcattatggatcatcccagtgaacctaatgccatcacgagggttcttatcagagacaggtagagggagatttgagtacagaagacaagatattcgtgtgatgatgcagacagagactggagtgatgccaccacaagccaagcaatgcctggagccaccaggagctgggacaggcaggaaggattctcccttatacccctcagagcaatcttggcccctctgacgtcttgactttagacttctggtccccagaacggagagagaataaatctttcttgttttaaggctccaacaaattggtagtcacttgttacagcaaccacaggaaatgtatacagcttctgatacttctgaaaacctcacacagccaaagggtacatccttggtatagaggctcactcttactcaccagccaggcaaggaaggctcaatcctttggtgttagagagatagatgttgggttttcaaatttcaacatagagaaatcagtcatttgcaatgcttttgagaaagtactgtgtataccctacgagcctgcactccttatgtgtgagactgatgaccattggttggcttattatccattccactaagtgacaaaatcccactgactattcaaatccaggctcctggcatgcctgtaccttagaatcacaaccagctgcaattccaggatggagttcaaactaattgtgggggcatgtgcttcttacatgactgctagattgttcccagatggggaaggttgccctgataagcaacttaaatgaaaataataaatgtattgtttggcctcttt

SEQ ID NO: 126050 - DNA, 744 bp, Homo sapiens
  Payload ID: 4719
  Gene Symbol: DHRSX
  Gene Name: dehydrogenase/reductase (SDR family) X-linked
  ENST ID: ENST00000412516
  CDS Start-End: 49-744
gagtcccgcgggcggcgcggaagcggcggcggcgcggccggggcagccatgtcgccattgtctgcggcgcgggcggccctgcgggtctacgcggtaggcgccgcggtgatcctggcgcagctgctgcggcgctgccgcgggggcttcctggagccagttttccccccacgacctgaccgtgtcgctatagtgacgggagggacagatggcattggctattctacagcgaagcatctggcgagacttggcatgcatgttatcatagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacc

SEQ ID NO: 126051 - DNA, 797 bp, Homo sapiens
  Payload ID: 4719
  Gene Symbol: DHRSX
  Gene Name: dehydrogenase/reductase (SDR family) X-linked
  ENST ID: ENST00000444280
  CDS Start-End: 433-797
gtgcgcgctgggacctccccgccccgcgctttccgtccccgccggctcttctgcgcgcctggcccggcccgacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccaggttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgc

SEQ ID NO: 126052 - DNA, 539 bp, Homo sapiens
  Payload ID: 4719
  Gene Symbol: DHRSX
  Gene Name: dehydrogenase/reductase (SDR family) X-linked
  ENST ID: ENST00000441131
  CDS Start-End: 39-230
caaacacagcgggtgttaggatctgtgtggagtcccggatgccagttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagagacgtgagtcttgctgtgttgcccgggctggctttgcctctggaactcaagcgatcctcccacctcagcctctcgaggagctgggactacaggcgtgcaccatcatttcctcctaaaatttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaacct

SEQ ID NO: 126053 - DNA, 679 bp, Homo sapiens
  Payload ID: 4719
  Gene Symbol: DHRSX
  Gene Name: dehydrogenase/reductase (SDR family) X-linked
  ENST ID: ENST00000478825
  CDS Start-End: 1-464
gcccggcccgacccggcccgacccttccctccccgcgcgtgtggcctccccgcctgtcccgggtcgggctccaaccaagcagcccccgtgcagccgcccccccgcgcaccctgacacctccgggccatggccggggacccgggggctcgcacgccccgcgcccaagacatcaggcggctctgcctgccgcctgcggtcggccagtgaccgcgcgcccccgccaggccccggaggggaggagcgggcgtcccagggacctcgacccctacccaccccaggttttccccccacgacctgaccgtgtcgctatagtgacgggagggacagatggcattggctattctacagcgaagcatctggcgagacttggcatgcatgttatcatagctggaaataatgacagcaaagccaaacaagttgtaagcaaaataaaagaagaaaccttgaacgacaaagagacgtgagtcttgctgtgttgcccgggctggctttgcctctggaactcaagcgatcctcccacctcagcctctcgaggagctgggactacaggcgtgcaccatcatttcctcctaaaatttggaatttttatactgtgacttggcttccatgacttccatccggcagtttgtgcagaagttcaagatgaagaagattcctctccatgtcctgatcaacaatg

SEQ ID NO: 126054 - DNA, 1658 bp, Homo sapiens
  Payload ID: 4720
  Gene Symbol: DIO1
  Gene Name: deiodinase, iodothyronine, type I
  Uniprot ID: P49895
  ENST ID: ENST00000322679
  CDS Start-End: 24-509
gagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggc

SEQ ID NO: 126055 - DNA, 1861 bp, Homo sapiens
  Payload ID: 4720
  Gene Symbol: DIO1
  Gene Name: deiodinase, iodothyronine, type I
  Uniprot ID: P49895
  ENST ID: ENST00000361921
  CDS Start-End: 25-774
agagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggcta

SEQ ID NO: 126056 - DNA, 606 bp, Homo sapiens
  Payload ID: 4720
  Gene Symbol: DIO1
  Gene Name: deiodinase, iodothyronine, type I
  Uniprot ID: P49895
  ENST ID: ENST00000388876
  CDS Start-End: 1-606
atggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaa

SEQ ID NO: 126057 - DNA, 771 bp, Homo sapiens
  Payload ID: 4720
  Gene Symbol: DIO1
  Gene Name: deiodinase, iodothyronine, type I
  ENST ID: ENST00000530084
  CDS Start-End: 23-271
agcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaat

SEQ ID NO: 126058 - DNA, 523 bp, Homo sapiens
  Payload ID: 4720
  Gene Symbol: DIO1
  Gene Name: deiodinase, iodothyronine, type I
  ENST ID: ENST00000529329
  CDS Start-End: 1-177
atggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtccgttggcagcgactagaggacacgactgagctagggggtctggccccaaactgcccggtggtccgcctctcaggacagaggtgcaacatttgggagtttatgcaagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaa

SEQ ID NO: 126059 - DNA, 688 bp, Homo sapiens
  Payload ID: 4720
  Gene Symbol: DIO1
  Gene Name: deiodinase, iodothyronine, type I
  ENST ID: ENST00000529589
  CDS Start-End: 137-688
agcagggaaggcggagagagaacacttccattccagttacagttccactgaattggaagctgtaactaccacttaggcatttttggcttctcataccactgcaccagcagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaag

SEQ ID NO: 126060 - DNA, 614 bp, Homo sapiens
  Payload ID: 4720
  Gene Symbol: DIO1
  Gene Name: deiodinase, iodothyronine, type I
  ENST ID: ENST00000528946
  CDS Start-End: 23-376
agcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaagttcaagaggcttattgaagactttagttccatagcagattttcttgtcatttacattgaagaagcacatgcatcagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatca

SEQ ID NO: 126061 - DNA, 626 bp, Homo sapiens
  Payload ID: 4720
  Gene Symbol: DIO1
  Gene Name: deiodinase, iodothyronine, type I
  ENST ID: ENST00000524406
  CDS Start-End: 264-626
atggggctgccccagccagggctgtggctgaagaggctctgggtgctcttggaggtggctgtgcatgtggtcgtggcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaa

SEQ ID NO: 126062 - DNA, 406 bp, Homo sapiens
  Payload ID: 4720
  Gene Symbol: DIO1
  Gene Name: deiodinase, iodothyronine, type I
  Uniprot ID: P49895
  ENST ID: ENST00000532493
  CDS Start-End: 1-342
atggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaagggtaaatctggcccttggaactacaacccagaggaagttcgtgctgttctggaaaagctccacagttaa

SEQ ID NO: 126063 - DNA, 799 bp, Homo sapiens
  Payload ID: 4720
  Gene Symbol: DIO1
  Gene Name: deiodinase, iodothyronine, type I
  ENST ID: ENST00000527060
  CDS Start-End: 23-199
agcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatca

SEQ ID NO: 126064 - DNA, 558 bp, Homo sapiens
  Payload ID: 4720
  Gene Symbol: DIO1
  Gene Name: deiodinase, iodothyronine, type I
  Uniprot ID: P49895
  ENST ID: ENST00000525202
  CDS Start-End: 1-558
atggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaa

SEQ ID NO: 126065 - DNA, 573 bp, Homo sapiens
  Payload ID: 4720
  Gene Symbol: DIO1
  Gene Name: deiodinase, iodothyronine, type I
  ENST ID: ENST00000525044
  CDS Start-End: 23-271
agcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtaataggccactggtgctgaattttggaagttgtacctgaccttcatttatgttcaaatttgaccagttcaagaggcttattgaagactttagttccatagcagattttcttgtcatttacattgaagaagcacatgcatcagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatca

SEQ ID NO: 126066 - DNA, 1856 bp, Homo sapiens
  Payload ID: 4720
  Gene Symbol: DIO1
  Gene Name: deiodinase, iodothyronine, type I
  ENST ID: ENST00000613679
  CDS Start-End: 24-770
gagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtaccccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggct

SEQ ID NO: 126067 - DNA, 1656 bp, Homo sapiens
  Payload ID: 4720
  Gene Symbol: DIO1
  Gene Name: deiodinase, iodothyronine, type I
  ENST ID: ENST00000617230
  CDS Start-End: 24-506
gagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtaccccttcatttatgttcaaatttgaccagttcaagaggcttattgaagactttagttccatagcagattttcttgtcatttacattgaagaagcacatgcatcagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggct

SEQ ID NO: 126068 - DNA, 796 bp, Homo sapiens
  Payload ID: 4720
  Gene Symbol: DIO1
  Gene Name: deiodinase, iodothyronine, type I
  ENST ID: ENST00000610607
  CDS Start-End: 23-277
agcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtccgttggcagcgactagaggacacgacgctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatca

SEQ ID NO: 126069 - DNA, 6136 bp, Homo sapiens
  Payload ID: 4721
  Gene Symbol: DIO2
  Gene Name: deiodinase, iodothyronine, type II
  Uniprot ID: Q92813
  ENST ID: ENST00000438257
  CDS Start-End: 156-977
gggcttccttttaatttagttttttttccccttctcccccaacccccaaccttcccccttacctcccccaccccctttatcaccaccccccttttaaataagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaattgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaaggcttatctctgcccccattgatttttaacctcaaaatggtgttgagatttacgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctagagggcaggttagagacagtatgtatgccttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaa

SEQ ID NO: 126070 - DNA, 6272 bp, Homo sapiens
  Payload ID: 4721
  Gene Symbol: DIO2
  Gene Name: deiodinase, iodothyronine, type II
  ENST ID: ENST00000422005
  CDS Start-End: 50-487
tgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacagctaaattgtcctccatcaggttttagcaaagatggacacattttactagtatatgaagcttataaaagcagactactggtctactcacatttggatttatggatgactgacagtgttgtacttactctaaatttcccaaggcaaattagtctgtgttttggaaagaattctgcagctgaactatacattgtttctaagaaggagaaggtgccttaactttccaagaaaatttactgcaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaattgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaaggcttatctctgcccccattgatttttaacctcaaaatggtgttgagatttacgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctagagggcaggttagagacagtatgtatgccttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaagct

SEQ ID NO: 126071 - DNA, 517 bp, Homo sapiens
  Payload ID: 4721
  Gene Symbol: DIO2
  Gene Name: deiodinase, iodothyronine, type II
  ENST ID: ENST00000557125
  CDS Start-End: 1-171
atgggcatcctcagcgtagacttgctgatcacactgcaaattctgccaccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatcca

SEQ ID NO: 126072 - DNA, 776 bp, Homo sapiens
  Payload ID: 4721
  Gene Symbol: DIO2
  Gene Name: deiodinase, iodothyronine, type II
  ENST ID: ENST00000555844
  CDS Start-End: 1-112
catgctgacctcagagggactgcgctgcgtctggaagagcttcctcctcgatgcctacaaacagctaaattgtcctccatcaggttttagcaaagatggacacattttatgactagtatatgaagcttataaaagcagactactggtctactcacatttggatttatggatgactgacagtgttgtacttactctaaatttcccaaggcaaattagtctgtgttttggaaagaattctgcagctgaactatacattgtttctaagaaggagaaggtgccttaactttccaagaaaatttactgcaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtg

SEQ ID NO: 126073 - DNA, 1049 bp, Homo sapiens
  Payload ID: 4721
  Gene Symbol: DIO2
  Gene Name: deiodinase, iodothyronine, type II
  ENST ID: ENST00000555750
  CDS Start-End: 29-958
aagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacagctaaattgtcctccatcaggttttagcaaagatggacacattttatgactagtatatgaagcttataaaagcagactactggtctactcacatttggatttatggatggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctatt

SEQ ID NO: 126074 - DNA, 569 bp, Homo sapiens
  Payload ID: 4721
  Gene Symbol: DIO2
  Gene Name: deiodinase, iodothyronine, type II
  ENST ID: ENST00000554188
  CDS Start-End: 406-569
aaagtgcttgcaattgcatagagcaaagagcatgctgaacagtgatgttccagtttaaaaggacagagctgcaaacaaaggactttggacttgggccggaactacacatcagctctcctgggcctctagcttgccaactacggacactgtgacttttcagccatcacaattgttaggtagcctggaaaaaaaagagaagcaacagttcctgagggaagaatgcattaacaactcggatgggtgctgtctgccagcactgcagaggaacctacggagagggctgctgggagagaatgctcatacctcccaaggcgtcagcctgccctcccgcccccaagttgctttgctcaagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgct

SEQ ID NO: 126075 - DNA, 491 bp, Homo sapiens
  Payload ID: 4721
  Gene Symbol: DIO2
  Gene Name: deiodinase, iodothyronine, type II
  ENST ID: ENST00000553594
  CDS Start-End: 474-491
gaggagcagctggttgatccaggagagacagggaggcgctgagatgagatgagctctctcccttatgtggagaagtccttttaggaatctgccatgtttaaatgactttggacttgggccggaactacacatcagctctcctgggcctctagcttgccaactacggacactgtgacttttcagccatcacaattgttatttagggagaaagaagagattgagtcacagtttcagaaaagaaagggtagcctggaaaaaaaagagaagcaacagttcctgagggaagaatgcattaacaactcggatgggtgctgtctgccagcactgcagaggaacctacggagagggctgctgggagagaatgctcatacctcccaaggcgtcagcctgccctcccgcccccaagttgctttgctcaagagggtgaaggggaaccagagcgcacaagggaactgactcaggaggcagagaagatgggcatcctcagcgta

SEQ ID NO: 126076 - DNA, 417 bp, Homo sapiens
  Payload ID: 4721
  Gene Symbol: DIO2
  Gene Name: deiodinase, iodothyronine, type II
  ENST ID: ENST00000553968
  CDS Start-End: 399-417
gcagagagaggcactttgcaccacagacagatagcaagaagggaaagacagagagtgagaaaaaagaggagtcagtcgctcctggggaagggagagagtgagactgggagaaagagaagcacagaaagtgtgtgtaaaacggagtaaagaaagaaaaaaaaaaaactacccttaaagcacatttaaaaaaaaaaaaaactctggcaattcaagaaagaaacaggctacgtttaaagagcatagagacaatgaaaggctaaagaaaattttaaaatctctgccacagtctcataggtgcttggaaatgaaagtagaactgcctgtctttaacggactctgacagagagggtgaaggggaaccagagcgcacaagggaactgactcaggaggcagagaagatgggcatcctcagcgtag

SEQ ID NO: 126077 - DNA, 6367 bp, Homo sapiens
  Payload ID: 4721
  Gene Symbol: DIO2
  Gene Name: deiodinase, iodothyronine, type II
  Uniprot ID: Q92813
  ENST ID: ENST00000557010
  CDS Start-End: 387-1208
agactggtctagcctcccagcctacatctttcttcagtgctggatgcttcctgccctcaaacatcggactccaagttcttcagttttgagactcagactgactgtccttgctcctcaagcttgcagacagcctattgtgggacgttgtgatcattaggtagcctggaaaaaaaagagaagcaacagttcctgagggaagaatgcattaacaactcggatgggtgctgtctgccagcactgcagaggaacctacggagagggctgctgggagagaatgctcatacctcccaaggcgtcagcctgccctcccgcccccaagttgctttgctcaagagggtgaaggggaaccagagcgcacaagggaactgactcaggaggcagagaagatgggcatcctcagcgtagacttgctgatcacactgcaaattctgccagtttttttctccaactgcctcttcctggctctctatgactcggtcattctgctcaagcacgtggtgctgctgttgagccgctccaagtccactcgcggagagtggcggcgcatgctgacctcagagggactgcgctgcgtctggaagagcttcctcctcgatgcctacaaacaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagtaagtaaccatatcacctctcttcttagtaaaaagccctatgtgaaaagatcccaagatggagaggaagaaacgctaattcagcatgtgttcattctgcattgagaaggaactgatacatctgatgcatgctttgagaccagaagaaaagacttacctgaataattactacattagggaagctactgtctacgttaagataaagggtattgccttggctctatttggcatggatggagcccagttggaaaattcccaaatattacaacaagtccttgaacccaggccatgtggttagacgttggtgttaaggttagaccttatgttagagtcatttctgatgttccagcttctagccatgtagtgctctcagtcttcataccccagaaattattggtatatttgtagataccgagaatgatccctcagtctgagaggttagaatgatcatctgtaatctgagggttaatttctaggcaggtggagagagtggtaaaaaagaaatgaaattgacaagctaggaaagaggaggcagaaagatttggaaaattcacagagtttcacccttaagctgtagagagtgggtcacatttgttagccacggaaacatagaaacatacacaaggccagaaaaagaagaaggagctcaactaaaagtggcatagagaatacacatataaaaacaatatatttgtcatatgctcctagagaggagaaaggggtgattgaaagaaaaaaaaatacttaaatatttgtaattgtgaggggtttcttttggaaataattacttttgaaccatgtatgtggtatgtatattttcagtgggttaattataccccatgatacctattaaaggaaaaccagtgggtctggtggtgctggtcttttcctccccattcctacaatttctatgtggcccaagtcattcctaatcttggtctctatagcagtgttctctctgaatgctgagctgaagaaattatacgtacatacacacatacatacatacatacaaatatatgtatatatattctcagctgctgcgggaggtaggtaccatggccattcagcacagccttgatttcctcccaaagtaggtgagctatagtgaagaataggtgcaaacaaacaagcttacttccattgcaaaatagaagaagaggaagttagagataattctgatcaatcattttggaggctttgttataaggcaacccccggtatatcatggaatttccattgacatttgaatttggacttggatcttcccttggtcccattagctgaggtttagtaatctaaagtccctatagtatatgattataatgctattttaaaaaatatatatataaaatatttttttctttttaaaatagacactatagttttacccataagtaatatttaaagattatagctcccaaaagaatggaccaaccactttcgtatcataatttctttttggtaaatatgagactattatgaaatcatagtatatgattgtatttaaaggtacaatcaaaggatcttttgtccattccattaataactgaataaaaaataaataaaatggatagaaaaaaactaaagttgaaaatacattcttaaactagttgtctgaattgagaaaagagtgagaactaggtgtgcaagaaccaaacgtattttattttattttttaaatgggagcaacatatcagtcgtgtcaccagctggtatattgtgtaaatattaaagctccattgggactgatttttcatggcaacatcagctttctaatgttctaaattctataaaaaccacccacaaagaaacaaagcaaatttcattatctaatgagttgctggaaaatcatattgagaataattatttcagattcctcagttgttaacttctacattcaaggcttatctctgcccccattgatttttaacctcaaaatggtgttgagatttacgtggaaccctaaagcagtaaaataaaaaacctggttgcagcacattcacactgttgtccttaaaattccccttttttctctatgtacgataaagtaacagtatgtcagataagccggtggggggatgagattaggctgaggcagtgctagtcaactggggaaaaggatgatggaaaaatcacccagttgtgctatatttttaaagaaggaggtcgtttatgtgtgcagacaattctccctgaggttagcccaatggagaaatgaagcagaggaaggaaacatagaaagacatgggctatcagggaggaagatgttcaatagaacatgcaagaatttctggaagaaaggctgtggaagggccaatggagaaaatgaatggacaaagctcaggaatcctacgctatgtagaatgtcttggtgttatcagggttaagcctgtaattatgtaacctatttatcgcaacatgaatttttatgatttcttgtgatgtattcttttatgaaattaacaagaactcattattttgaggtagaggaaaatcaatgctttatctgatatgctgagaaattattagattgccaatactcatgtgcgtttcatgtgttttataaggtttgttcctttgaagaattgtagttcttagtcccacagggaaatgtgtatctatttatatatcatagtataaatctatgatatatttatatcatatataaaagtctgagttctctttcttagtccctaatcatgtttctcccataggctgtgtttacatggagctatcggtttagccttttaagcttcattagcttgtctattattgaaatagtttccaagaaattttagatattatcataacatctgggtctactcaaacacttattgtttgaaagacttatgtcttggacctatcaaaaactgactttatttattgcttagtgaaaatactagtgggatcaacaatgattttcttgaatgggcatgaatggagatgcccgcacagtaatgtagaaatgtttcatacagctattaaaatgtaactgacctccttagaggcagattagtaactgttcctactttgtatagctaagtgacagtcacttaacttacatgactttcttttttcacattgggtctctggtcctgtgtcttcacctcatttatagcacgtctccttgatttttggtagtatcaacttcccagtgatctgttcagttaagttcttctcccgttaaccaggaagtgcttattctctcatcacagtgggaagaatagcctattgtctttcattttgcctgagtgtattttactatttgggctctgaaataaaaattatgaaatatggtgaggtcacatgttggtgctgccttgctgcataaaattctagagggcaggttagagacagtatgtatgccttcgggaaaattcaaaggtggattacaaggtgtcctcagcatgccctatggcctatgtgcgaagcaagaagaattgactgatttacaggacttctctttatgtcaatcttaagaggatggatgaatctggacatttgttccacccgacctctgactgatggtttggaaaataactttaattaggatcatatgaccattgaaaaaggaaaaatgtagactctgacttccgtcccactgaaggattaatgaaaacctttactagcatttagagcttttcagaacatccccactgtcatgtgtctcagcagtggagactgcaagtaaggcttttaattttaggaggtttttttttttttttttttttccctaaatggtatggccaaaagtcagagttaaaatatatatagttagattccaacttcctccttcactctaaaaatagaatccaaacccactcttcatatatgcttccagaatggggcttaagtaccaatctctgctttgcaatgggcacaatcttggtcatgtcctgaggctctctaagaaaagagaggatctaggatgggagagctagaaagttgctaactgggaagaacaaggccctgagggcttggtctaccaatctgggaagatttgaaaacaaacttctcgcaactgaaggaaggctgaaggctgctgcaagtcattgagtgactttaggatgagcaaaacattgggccacttcctaatgccctatgtgtatagtaccagaagcaaggtctcagacttaacagacccagctctgttccaaggtgagtctgaaccaatagaaagcaaacatgtgcagatatccaaacaagactgctcatgcaagtcggggctggctacccgtcttaggcagcaacagcagagctccagggagcttattcaatatttactgagacttcgaagacccagcagatgtttaatgaagtcactattttggctcaaaccctccacttctccccctcccctcaaaaagccaacaggtaaacacataaatgaaagaaacccacagaaggggatgggaaataaagaaaattctctcaagacttctccaggcccatgtcactggtcagcgtggtttttatgtgtattaggattgggggatgtgaagaaataagtatccagtactttataaccaaagcaattaaatgatattgggtagggaatgttggccagttttgtttagttttgcatcacattgtcaccagactcactagcccaagtaatcgggcgcccgaagagggagacagagatgtgcagagttgaccagtgtgcggatgataactactgacgaaagagtcatcgactcagttagtggttggatgtagtcacattagtttgcctctccccatctttgtctccctggcaaggagaatatgcgggacatgatgctaagagtcctgggtaaatgtggtgagaatgcacgcgtgcatatgctacacatatgtgcttctcagttgcagaaaatgaactgctttgggagattatcagtagaaagagtgttatcatattggtgctgagtgctatgtgtgcttatacaatttgttcttgtattttaataaactttgaataaaagaataaa

SEQ ID NO: 126078 - DNA, 984 bp, Homo sapiens
  Payload ID: 4721
  Gene Symbol: DIO2
  Gene Name: deiodinase, iodothyronine, type II
  ENST ID: ENST00000556811
  CDS Start-End: 1-175
catgctgacctcagagggactgcgctgcgtctggaagagcttcctcctcgatgcctacaaacagactgacagtgttgtacttactctaaatttcccaaggcaaattagtctgtgttttggaaagaattctgcagctgaactatacattgtttctaagaaggagaaggtgccttaactttccaagaaaatttactgcaggtgaaattgggtgaggatgcccccaattccagtgtggtgcatgtctccagtacagaaggaggtgacaacagtggcaatggtacccaggagaagatagctgagggagccacatgccaccttcttgactttgccagccctgagcgcccactagtggtcaactttggctcagccacttgacctcctttcacgagccagctgccagccttccgcaaactggtggaagagttctcctcagtggctgacttcctgctggtctacattgatgaggctcatccatcagatggctgggcgataccgggggactcctctttgtcttttgaggtgaagaagcaccagaaccaggaagatcgatgtgcagcagcccagcagcttctggagcgtttctccttgccgccccagtgccgagttgtggctgaccgcatggacaataacgccaacatagcttacggggtagcctttgaacgtgtgtgcattgtgcagagacagaaaattgcttatctgggaggaaagggccccttctcctacaaccttcaagaagtccggcattggctggagaagaatttcagcaagagatgaaagaaaactagattagctggttaaaggtatgattataagagagcttattgttttaaaaagttatataaaggcaaggaaattaagaactgaatccatatttcaacagagccctattggcttactgaaagacaggagtttatctatcggaagaacatgaatctctaacagctccatacttctttcactactcaaatggcattgggctgagta

SEQ ID NO: 126079 - DNA, 2102 bp, Homo sapiens
  Payload ID: 4722
  Gene Symbol: DIO3
  Gene Name: deiodinase, iodothyronine, type III
  Uniprot ID: P55073
  ENST ID: ENST00000510508
  CDS Start-End: 147-1061
agcccaagatttctagggcattggccgcgctgctgggtgatccctccgggctcaagttgcaagggggcgggccgggccggaggtggagtctcccgccaattgaagcctccgctataaattgaactccctgcactgctgaagcccagatgcctcgccaggccacgtcgcggttggtggtcggagagggcgaggggtcccagggggcttcggggcctgcagccaccatgctccgctccctgctgcttcactccttgaggctctgcgcccagaccgcctcgtgcctcgtgctcttcccgcgcttcctcggcacggccttcatgctctggcttctcgatttcttgtgtatccgcaagcatttcctgggccgccgccgccgggggcagcccgagcccgaagtggagctcaacagtgaaggcgaggaggtgcctcccgatgacccgcccatctgcgtgtccgacgacaaccgcctgtgcaccctggcgtcgctcaaggcggtgtggcatggccagaagttggatttcttcaagcaggcgcacgagggcggtccggcgcccaactccgaggtggttctgcccgacggcttccagagccagcacatcctcgactacgcgcaagggaaccgcccgctggttctcaatttcggcagctgcacctgaccaccgttcatggcgcgcatgagcgccttccagcgcctggtcactaagtaccagcgcgacgtcgacttcctcatcatctacatcgaggaagcgcacccctccgacggctgggtcaccacggactctccctacatcatcccacagcaccggagcctggaggaccgggtcagcgcagcgagggtactgcagcaaggtgcacccggctgcgctctggtcctcgacaccatggccaactccagcagctcggcctatggcgcctacttcgagcgtctctatgtcatccagagtggcactattatgtaccagggcggccgtggccccgacggctaccaggtctctgagctgcgcacttggttggaacgctatgatgagcaactgcacggcgctcggccccggagggtgtaaacatccaacggacaattgactgaacttggtgggctgggccttcgagccttcgaagcccacgtgcaagcgcctcaaaccaagtcacgcttggcgaggccccagtgacactgatgtgctgagccaccatttcagactgagtctgcaccctcagccacatgaacaatctcccctacctccctgggactctgcttctgtaactgtctcattcacacctgcctggctcactggaaatcctcttttgagcgcgggatatggcttgcccttgtccgtgtgcccccaggactttgcctctacagcattttcttacaccccctccccagcgtgccctcagccaagtgctttggcccggtgcttcccgcagctgcacagagaccttggccacgcccgcgcgccctgagcgcagctgggttccaggagactctcagctcagctgagctagttgcctggcacccacctgtcgcgcgcggagagggggttccctgttgcttttgtgtctgtttcctgtccctggtaggggaagtgatgtcgtggatggggaggggtgggcagggtagtttcccccgcttgttttgggtgcacaggagccccactgctgatgacgaactatctctaactggtcttgaccacgagctagttctgaattgcaggggcctcaaagcagcacctaaaccttgagggggagggtgctctgggtttccgtgaggtaaccaccttaaatgggagggaagttggggtgtctgctttgggaccagaggaagatagcttgagaggcattggcgaggttcgcagcgccccagggagagagaaaaagctgagactcctggggaatgacgttggggtgatggagtccggggaaagagaggtggggggagagcctgaggtccccaagtgaggggagtcctaggcagagctgctgattgtggggctgggaggtggagggcccctgattcgaaggccatttggtgagtgttttgctggaaatatttcctgtatataaacttctttcaatctacaataataaaggcttgaggtaaactgctt

SEQ ID NO: 126080 - DNA, 1441 bp, Homo sapiens
  Payload ID: 4723
  Gene Symbol: DEK
  Gene Name: DEK proto-oncogene
  Uniprot ID: P35659
  ENST ID: ENST00000244776
  CDS Start-End: 167-1192
attttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtatttt

SEQ ID NO: 126081 - DNA, 3427 bp, Homo sapiens
  Payload ID: 4723
  Gene Symbol: DEK
  Gene Name: DEK proto-oncogene
  Uniprot ID: P35659
  ENST ID: ENST00000397239
  CDS Start-End: 449-1576
tccgcgctgccaggccgcctcgcctcccgctcccgcccgccccgcgggacacagcccgcccgcactccggggcccgagcgccgaccacactccaggcgcagccggggagagccccgcgcgcgcatccctccgcccgcggccgaggcgacccctcgcggtcccgcccgcccgagcttcccgcggaggcacccggccgccccgcctcccccgccccgcgcccgccaactcccagctcgcggccctgattggtcgccgcattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcactggtgttttaagtcacttgcatttgatatcttataggtgtatatagcatttccttatggggaataattctgaaaagggatttttaaattgattcagccctataacctatacaatttggaatactcttttgtggtaatggaccattttcttggagtgacttcacaaaactgaataattaaggttaattttatgaccatttgctataaagaaggtaagtagtcatgcatagagtatttggaagtgaggaaatggagttgttctgtatgaaagttcttgatgagtacgcacacttattaaatggatgtatcacca

SEQ ID NO: 126082 - DNA, 1372 bp, Homo sapiens
  Payload ID: 4723
  Gene Symbol: DEK
  Gene Name: DEK proto-oncogene
  ENST ID: ENST00000505224
  CDS Start-End: 161-1204
aaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacatcactttttaaactcacataggtaggtatctttatagttgtagactatggaatgtcagt

SEQ ID NO: 126083 - DNA, 730 bp, Homo sapiens
  Payload ID: 4723
  Gene Symbol: DEK
  Gene Name: DEK proto-oncogene
  ENST ID: ENST00000515770
  CDS Start-End: 1-485
agaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagtacaacctttctgctgtgaggacagaattctggctctgtgacaggcgtcttttttggagaccctccttcaagagccctgctgcctataaatcatagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgc

SEQ ID NO: 126084 - DNA, 739 bp, Homo sapiens
  Payload ID: 4723
  Gene Symbol: DEK
  Gene Name: DEK proto-oncogene
  ENST ID: ENST00000507591
  CDS Start-End: 1-471
attctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagaggtaaatatttcagtctttcaagtttgactttagaaatataagacaaaagtaattacataaaatactccatatttttcaaaatattcatgtcactaaatatcacatttgatcctcacatttcttcataatagggaaatttatttcttctcattcccactttaaagcttaaaattaaagtttgaacagttagtgataagacctgaactcagattatgatgtggcctcatggtgtacctgggtagctgggcatctcaacgttgctctcacaaatacttgaggaagttcctgtctacga

SEQ ID NO: 126085 - DNA, 661 bp, Homo sapiens
  Payload ID: 4723
  Gene Symbol: DEK
  Gene Name: DEK proto-oncogene
  ENST ID: ENST00000515742
  CDS Start-End: 207-661
gcgcggtttcccgcctcgggaatccctggacggcggcggcggagcgggagggaagccgcccctggggactgagcgctgcggtcccggctatgggaggaggcaactttcagggcaggtgtcccgcgggaagggtagcatcattcagggtggccgcccggtcctgcctgcgggagtaggaggaccgagacgtccggctttcttcccgcatgcaggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaaga

SEQ ID NO: 126086 - DNA, 580 bp, Homo sapiens
  Payload ID: 4723
  Gene Symbol: DEK
  Gene Name: DEK proto-oncogene
  ENST ID: ENST00000503715
  CDS Start-End: 214-580
attttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcgaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctg

SEQ ID NO: 126087 - DNA, 2382 bp, Homo sapiens
  Payload ID: 4724
  Gene Symbol: DAZ1
  Gene Name: deleted in azoospermia 1
  Uniprot ID: Q9NQZ3
  ENST ID: ENST00000382510
  CDS Start-End: 124-1965
ctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttca

SEQ ID NO: 126088 - DNA, 4421 bp, Homo sapiens
  Payload ID: 4724
  Gene Symbol: DAZ1
  Gene Name: deleted in azoospermia 1
  Uniprot ID: Q9NQZ3
  ENST ID: ENST00000405239
  CDS Start-End: 295-2529
gctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126089 - DNA, 1846 bp, Homo sapiens
  Payload ID: 4724
  Gene Symbol: DAZ1
  Gene Name: deleted in azoospermia 1
  ENST ID: ENST00000426000
  CDS Start-End: 209-1309
agtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcagccatttcctgcttatccaagttcaccatttcaggtcactgctggatatcagttgcctgtatataattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatc

SEQ ID NO: 126090 - DNA, 3268 bp, Homo sapiens
  Payload ID: 4724
  Gene Symbol: DAZ1
  Gene Name: deleted in azoospermia 1
  ENST ID: ENST00000540248
  CDS Start-End: 211-1383
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttc

SEQ ID NO: 126091 - DNA, 1891 bp, Homo sapiens
  Payload ID: 4724
  Gene Symbol: DAZ1
  Gene Name: deleted in azoospermia 1
  ENST ID: ENST00000620725
  CDS Start-End: 188-1648
ctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctccttatccaaactcaccaggtcaggtcatcactgggtatcagttgcctgtgtataattatcaggcttattctccttatccaaactcaccaggtcaggtcatcactgggtatcagttgcctgtgtataattatcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagacatatcctacttatccaaattcaccaggtcaggtcaccactgggtgtcagttgcctgtatgtaattatcaggtgctaccgcagtggcctgttggggagcaaaagagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactg

SEQ ID NO: 126092 - DNA, 3277 bp, Homo sapiens
  Payload ID: 4725
  Gene Symbol: DAZ2
  Gene Name: deleted in azoospermia 2
  ENST ID: ENST00000382294
  CDS Start-End: 285-1385
attggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagttcaccatttcaggtcactgctggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126093 - DNA, 3781 bp, Homo sapiens
  Payload ID: 4725
  Gene Symbol: DAZ2
  Gene Name: deleted in azoospermia 2
  Uniprot ID: Q13117
  ENST ID: ENST00000382306
  CDS Start-End: 285-1889
attggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126094 - DNA, 3853 bp, Homo sapiens
  Payload ID: 4725
  Gene Symbol: DAZ2
  Gene Name: deleted in azoospermia 2
  Uniprot ID: Q13117
  ENST ID: ENST00000382424
  CDS Start-End: 285-1961
attggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126095 - DNA, 3637 bp, Homo sapiens
  Payload ID: 4725
  Gene Symbol: DAZ2
  Gene Name: deleted in azoospermia 2
  ENST ID: ENST00000382431
  CDS Start-End: 285-1745
attggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126096 - DNA, 2405 bp, Homo sapiens
  Payload ID: 4725
  Gene Symbol: DAZ2
  Gene Name: deleted in azoospermia 2
  Uniprot ID: Q13117
  ENST ID: ENST00000382433
  CDS Start-End: 194-1870
ctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgattta

SEQ ID NO: 126097 - DNA, 4119 bp, Homo sapiens
  Payload ID: 4725
  Gene Symbol: DAZ2
  Gene Name: deleted in azoospermia 2
  ENST ID: ENST00000382440
  CDS Start-End: 267-2231
cacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 126098 - DNA, 3791 bp, Homo sapiens
  Payload ID: 4725
  Gene Symbol: DAZ2
  Gene Name: deleted in azoospermia 2
  Uniprot ID: Q13117
  ENST ID: ENST00000382449
  CDS Start-End: 295-1899
gctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126099 - DNA, 3516 bp, Homo sapiens
  Payload ID: 4725
  Gene Symbol: DAZ2
  Gene Name: deleted in azoospermia 2
  ENST ID: ENST00000400493
  CDS Start-End: 308-1624
agggggcgggtgtgctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccatttcaagtcgccactggatatcagttccctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126100 - DNA, 3372 bp, Homo sapiens
  Payload ID: 4725
  Gene Symbol: DAZ2
  Gene Name: deleted in azoospermia 2
  ENST ID: ENST00000449947
  CDS Start-End: 308-1480
agggggcgggtgtgctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttattctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126101 - DNA, 3277 bp, Homo sapiens
  Payload ID: 4726
  Gene Symbol: DAZ3
  Gene Name: deleted in azoospermia 3
  ENST ID: ENST00000315357
  CDS Start-End: 285-1385
attggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126102 - DNA, 3503 bp, Homo sapiens
  Payload ID: 4726
  Gene Symbol: DAZ3
  Gene Name: deleted in azoospermia 3
  Uniprot ID: Q9NR90
  ENST ID: ENST00000382365
  CDS Start-End: 295-1611
gctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126103 - DNA, 3372 bp, Homo sapiens
  Payload ID: 4726
  Gene Symbol: DAZ3
  Gene Name: deleted in azoospermia 3
  ENST ID: ENST00000446723
  CDS Start-End: 308-1480
agggggcgggtgtgctgccacccattggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126104 - DNA, 2048 bp, Homo sapiens
  Payload ID: 4727
  Gene Symbol: DAZ4
  Gene Name: deleted in azoospermia 4
  ENST ID: ENST00000382296
  CDS Start-End: 1-1956
atgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcc

SEQ ID NO: 126105 - DNA, 3910 bp, Homo sapiens
  Payload ID: 4727
  Gene Symbol: DAZ4
  Gene Name: deleted in azoospermia 4
  ENST ID: ENST00000382314
  CDS Start-End: 211-2022
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 126106 - DNA, 2405 bp, Homo sapiens
  Payload ID: 4727
  Gene Symbol: DAZ4
  Gene Name: deleted in azoospermia 4
  ENST ID: ENST00000382432
  CDS Start-End: 194-1870
ctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgattta

SEQ ID NO: 126107 - DNA, 3271 bp, Homo sapiens
  Payload ID: 4727
  Gene Symbol: DAZ4
  Gene Name: deleted in azoospermia 4
  Uniprot ID: Q86SG3
  ENST ID: ENST00000449750
  CDS Start-End: 211-1383
tcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaa

SEQ ID NO: 126108 - DNA, 3277 bp, Homo sapiens
  Payload ID: 4727
  Gene Symbol: DAZ4
  Gene Name: deleted in azoospermia 4
  ENST ID: ENST00000415508
  CDS Start-End: 285-1385
attggctcaggccgataccacgcgccccgatacccggcacaggagccacctcccagagccccgcagtccatgcctcagtcggcctgcgctcctcagcctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagttcaccatttcaggtcactgctggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactgaaactgttcttcattagatgtttatttagaacctggttctgtgtttaatatatagtttaaagtaacaaataatcgagactgaaagaatgttaagatttatctgcaaggatttttaaaaaattgaaacttgcattttaagtgtttaaaagcaaatactgactttcaaaaaagtttttaaaacctgatttgaaagctaacaattttgatagtctgaacacaagcatttcacttctccaagaagtacctgtgaacagtacaatatttcagtattgagctttgcatttatgatttatctagaaatttacctcaaaagcagaatttttaaaactgcatttttaatcagtggaactcaatgtatagttagctttattgaagtcttatccaaacccagtaaaacagattctaagcaaacagtccaatcagtgagtcataatgtttattcaaagtattttatcttttatctagaatccacatatgtatgtccaatttgattgggatagtagttaggataactaaaattctgggcctaattttttaaagaatccaagacaaactaaactttactgggtatataaccttctcaatgagttaccattcttttttataaaaaaaattgttccttgaaatgctaaacttaatggctgtatgtgaaatttgcaaaatactggtattaaagaacgctgcagcttttttatgtcactcaaaggttaatcggagtatctgaaaggaattgtttttataaaaacattgaagtattagttacttgctataaatagatttttatttttgttttttagcctgttatatttccttctgtaaaataaaatatgtccagaagaggcatgttgtttctagattaggtagtgtcctcattttatattgtgaccacacagctagagcaccagagcccttttgctatactcacagtcttgttttcccagcctcttttactagtctttcaggaggtttgctcttagaactggtgatgtaaagaatggaagtagctgtatgagcagttcaaaggccaagccgtggaatggtagcaatgggatataatacctttctaagggaaacatttgtatcagtatcatttgatctgccatggacatgtgtttaaagtggctttctggcccttctttcaatggcttcttccctaaaacgtggagactctaagttaatgtcgttactatgggccatattactaatgcccactggggtctatgatttctcaaaattttcattcggaatccgaaggatacagtctttaaactttagaattcccaagaaggctttattacacctcagaaattgaaagcaccatgactttgtccattaaaaaattatccatagtttttttagtgcttttaacattccgacatacatcattctgtgattaaatctccagatttctgtaaatgatacctacattctaaagagttaattctaattattccgatatgaccttaaggaaaagtaaaggaataaatttttgtctttgttgaagtatttaatagagtaaggtaaagaagatattaagtccctttcaaaatggaaaattaattctaaactgagaaaaatgttcctactacctattgctgatactgtctttgcataaatgaataaaaataaactttttttcttcaaatgtg

SEQ ID NO: 126109 - DNA, 1891 bp, Homo sapiens
  Payload ID: 4727
  Gene Symbol: DAZ4
  Gene Name: deleted in azoospermia 4
  ENST ID: ENST00000440066
  CDS Start-End: 188-1648
ctggcggttctacctccgagggttcgcccgcccttggttttccttacaccttagcctttggctcctttgaccactcgaagccccacagcgtgttccagcggacttcaccagcagacccagaagtggtgggtgaaacactgcctctgttcctccttgagcctgtcgggagctgctgcctgccaccaccatgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcctctcagctatctagtttcatgggaagttgctggttttgaatattaagctaaaagttttccactattacagaaattctgaattttggtaaatcacactgaaactttctgtataacttgtattattagactctctagttttatcttaacactg

SEQ ID NO: 126110 - DNA, 1832 bp, Homo sapiens
  Payload ID: 4727
  Gene Symbol: DAZ4
  Gene Name: deleted in azoospermia 4
  ENST ID: ENST00000634662
  CDS Start-End: 1-1740
atgtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcagtctgctgcaaatcctgagactccaaactcaaccatctccagagaggccagcacccagtcttcatcagctgcagctagccaaggctgggtgttaccagaaggcaaaatcgtgccaaacactgtttttgttggtggaattgatgctaggatggatgaaactgagattggaagctgctttggtagatacggttcagtgaaagaagtgaagataatcacgaatcgaactggtgtgtccaaaggctatggatttgtttcgtttgttaatgacgtggatgtccagaagatagtaggatcacagatacatttccatggtaaaaagctgaagctgggccctgcaatcaggaaacaaaagttatgtgctcgtcatgtgcagccacgtcctttggtagttaatcctcctcctccaccacagtttcagaacgtctggcggaatccaaacactgaaacctacctgcagccccaaatcacgccgaatcctgtaactcagcacgttcaggcttactctgcttatccacattcaccaggtcaggtcatcactggatgtcagttgcttgtatataattatcaggaatatcctacttatcccgattcagcatttcaggtcaccactggatatcagttgcctgtatataattatcagccatttcctgcttatccaagatcaccatttcaggtcactgctggatatcagttgcctgtatataattatcaggcatttcctgcttatccaaattcaccatttcaagtcgccactggatatcagttccctgtatacaattatcagccatttcctgcttatccaagttcaccatttcaggtcactgctggatatcagttgcctgtatataattatcaggcatttcctgcttatccaaattcaccatttcaagtcgccactggatatcagttccctgtatacaattatcaggcatttcctgcttatccaaattcaccagttcaggtcaccactggatatcagttgcctgtatacaattatcaggcatttcctgcttatccaagttcaccatttcaggtcaccactggatatcagttgcctgtatataattatcaggcatttcctgcttatccaaattcagcagttcaggtcaccactggatatcagttccatgtatacaattaccagatgccaccgcagtgccctgttggggagcaaaggagaaatctgtggaccgaagcatacaaatggtggtatcttgtctgtttaatccagagaagagactgataaattccgttgttactcaagatgactgcttcaagggtaaaagagtgcatcgctttagaagaagtttggcagtatttaaatctgttggatcc

SEQ ID NO: 126111 - DNA, 3104 bp, Homo sapiens
  Payload ID: 4728
  Gene Symbol: DAZL
  Gene Name: deleted in azoospermia-like
  Uniprot ID: Q92904
  ENST ID: ENST00000250863
  CDS Start-End: 289-1236
actcccacgcgcctccgccccgccagcctcatttctggcgcgctctccccgtggctccgcaagatggcggcgggcctgctgagggacttgccttcttaaacttcgagggccggagcttccttaggaagtggttccctcctggtccctgtacttggtggggtgggcggggttcgtgggggcctcagcgtggggtgtggggcgtcctgaaggcatggccctgtagctgagggggctgggccggaagtgcctctggtcccctcgcgcctgtcagctgcgggggacttgctgatggcggctccctcgtgtggcggcgacagaaaagctcgcctgacgccatctttgccgcacgagtctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcaggcatatcctacttacccaaattcaccagttcaggtcatcactggatatcagttgcctgtatataattatcagatgccaccacagtggcctgttggggagcaaaggagctatgttgtacctccggcttattcagctgttaactaccactgtaatgaagttgatccaggagctgaagttgtgccaaatgaatgttcagttcatgaagctactccaccctctggaaatggcccacaaaagaaatctgtggaccgaagcatacaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctataccacagtctttcgtttccagcctttgtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaagtttttttcttcaaaa

SEQ ID NO: 126112 - DNA, 3050 bp, Homo sapiens
  Payload ID: 4728
  Gene Symbol: DAZL
  Gene Name: deleted in azoospermia-like
  Uniprot ID: Q92904
  ENST ID: ENST00000399444
  CDS Start-End: 295-1182
attggctgaggccgataccacgcgccccgatacccggcgcaggagccacctccctgagccccgcggaccacgcctcagtccgcctgcgctcctcagcctgacggtccgcctttcggggctcctcagccttgtcacccgctcttggttttccttttctcttcatctttggctcctttgaccactcgaagccgcgcagcgggttccagcggacctcacagcagccccagaagtggtgcgccaagcacagcctctgctcctcctggagccggtcgggaactgctgcctgccgccatcatgtctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcaggcatatcctacttacccaaattcaccagttcaggtcatcactggatatcagttgcctgtatataattatcagatgccaccacagtggcctgttggggagcaaaggagctatgttgtacctccggcttattcagctgttaactaccactgtaatgaagttgatccaggagctgaagttgtgccaaatgaatgttcagttcatgaagctactccaccctctggaaatggcccacaaaagaaatctgtggaccgaagcatacaaacggtggtatcttgtctgtttaatccagagaacagactgagaaactctgttgttactcaagatgactacttcaaggataaaagagtgcatcactttagaagaagtcgggcaatgcttaaatctgtttgatcctcctggcttatctagttacatgggaagttgctggttttgaatattaagctaaaaggtttccactattatagaaattctgaattttggtaaatcacactcaaactttgtgtataagttgtattattagactctctagttttatcttaaactgttcttcattagatgtttatttagaaactggttctgtgttgaaatatagttgaaagtaaaaaaataattgagactgaaagaaactaagatttatctgcaaggattttttaaaaattggcattttaagtgtttaaaagcaaatactgattttcaaaaaaatgtttttaaaaacctattttgaaaggtcagaattttgttggtctgaatacaaacatttcacttctccaacaagtacctgtgaacagtacagtatttacagtattgagctttgcatttatgatttctccagaaatttaccacaaaagcaaaatttttaaaactgcatttttaatcagtggaactcaatatatagttagctttattgaagtcttcttatctaaacccagcaaaacagattcaaagcgaacagtccaatcagtgggtcatatgtttattcaaaatattttatcttttagctagaatccacacatatatatcctatttgattagggtagtaattaggataactaaaattctgggcctaattttttaaagaatccaagacaaactaaactttactaggtacataagcttctcaatgagtcaccattcttcttttttgtaaaaacttttttctttgaaatgctaaacttggctgtatgtcaaattgtgcaaaatattggtattaaagaatgctgcaacttttttatgtctcttagaggttaatcagagtatctgaagggaattgtttttataaaaacattgaaatattagttacttgctataaatagatttagtctgttatatttccttttgtaaagtaaaatatgtccagaagagtcaaagtagttagttttggttatttctaaaccacaaaagttgtttaataagtatatcttaagaatgtgctagagttaaaagttagcattgtttctagattagctggtgtcttcattttacattgtgacaaacagctagagcatcagagcccttttgctataccacagtctttcgtttccagcctttgtcactagtctttgaggaggtttgctcctagaactggtgatataaagaatgaaagtagctgtatgagcagagcagttcaagggccaaaccctggaacggtagcaatgggatataatacctttctaagggaaaaagttgtatcagtaccatttgatctgccatggacatgagtttaaagcggctttctggcccttctttcagtgacttcttccctaaaatgtagaaattctaacttaatgtagttactgtgagccatattactagtgccccctagggtctataattccttaaaattttcattctgaatctgaaggagagagtcttttaactttagaattcccaagagggctttattacacctcagaaattgaaagcactatgaatttgtccatttaaaaatgatctgtagtttttttggtgctataacattctgacacatatcattctgtgattaaatctccagcttactataaatgatatctatattctaaagagctacttctaattattccaatatgaccttaaggaaaagtaagggaataaatttttgtctttgttggagtgaagcatttaaaagagtaagggtaaaaaagataaagtcctgaacctttcaaaatggaaaattaattctaaacttagaaatatgcttctgcctattgctgatactgtctttgcatacatgaataaaaataaagtttttttcttcaaaa

SEQ ID NO: 126113 - DNA, 725 bp, Homo sapiens
  Payload ID: 4728
  Gene Symbol: DAZL
  Gene Name: deleted in azoospermia-like
  ENST ID: ENST00000454457
  CDS Start-End: 114-725
cctgagacaaaggccaggcctctcctcagggtacgttgcgctggttcatagctcatttatcaagcccatccacttctgcctgatcatcaaggccgccttcaacctgtccacccatgggagcagacccttaccactcatcagcacagtgcctcagcattctcttctccttgtctttgcactctccaggtctcccagtgctgatgtcttcctctctgctacttctgccaaagtctactgcaaatcctgaaactccaaactcaaccatctccagagaggccagcacccagtcctcatcagctgcaaccagccaaggctatattttaccagaaggcaaaatcatgccaaacactgtttttgttggaggaattgatgttaggatggatgaaactgagattagaagcttctttgctagatatggttcagtgaaagaagtgaagataatcactgatcgaactggtgtgtccaaaggctatggatttgtttcattttttaatgacgtggatgtgcagaagatagtagaatcacagataaatttccatggtaaaaagctgaagctgggccctgcaatcaggaaacaaaatttatgtgcttatcatgtgcagccacgtcctttggtttttaatcatcctcctccaccacagtttcagaatgtctggactaatccaaacactgaaacttatatgcagcccacaaccacgatgaatcctataactcagtatgttcag

SEQ ID NO: 126114 - DNA, 1251 bp, Homo sapiens
  Payload ID: 4729
  Gene Symbol: DEC1
  Gene Name: deleted in esophageal cancer 1
  Uniprot ID: Q9P2X7
  ENST ID: ENST00000374016
  CDS Start-End: 520-732
ctattgtttctacctcaccctggcccaggaagacagatctactgaggaaagccctgaacactctgcggcttctctgagaaaccctatcgaaggggatgtggaatcccagagctactcttgctatcaactcgccgcatgaccttgggaaaatcatttcacctggttcagcaatgatttactgagctattgaaggccttactttccagatccagatccttgtgcatacaactgacttgtgtgggtgaggcttgcagaaaaaatcagctagaacagccttgggggtagtggcaaggtggccagagcaattgactgggagctgggaacaggaatgaagaggaagagctgataagaaacatgcccagagcagatttgatgctactgccaatgtacctgaataagaagacaactctttctggaaaaagggaaaacttgaagggctattgaaggccgctagaaagtacagaaggaactttggatgtgggagagaaagacaaggagaaacctgaaagcagcccagttatgacaatgaatgttctggaggctgggaagtggaagagcattgtgccagcacctggtgagggccttcttgccgtgttacacatgatggtttttactgatgccctgcacagagagaggtctgtaaagtggcaagcaggagtctgctacaatggaggaaaggattttgctgtatctcttgccaggcccaaggctgcagagggaattgcagattgaatgtaagtgacttggaaaaggaagaggagttgccagaaacagctaaaatgtcagtagaagacttgacagcttgagaatagaggaaaaaataaaagcgaagcagacaaaaagaaccttacctcccccacaatacaacattgggctgctgaacccacaaaaatctaaatccgtttagaatcatctatttaactcctcagagacatgcacaaactattctagagaggcttgtgcctacgaagattacttaagaatgtgttgacacatttggagggggttaatttaccagttatcatttactagaaaggctttttctataagaatatatgaaagagtttcctcggagcattcaaccgggcttctttgtagggtatgtgtactgcttggagctacggaagaccacgtcctagaagtgctgtgtccctgaggcacacctatgtgtgttatctctctggcatactttccaacaaggattcttttctagtctatacattctgattaatttgcagtcagaggcaatgc

SEQ ID NO: 126115 - DNA, 210 bp, Homo sapiens
  Payload ID: 4729
  Gene Symbol: DEC1
  Gene Name: deleted in esophageal cancer 1
  ENST ID: ENST00000614246
  CDS Start-End: 1-210
ttatttcttccagttctggaggctgggaagtggaagagcattgtgccagcacctggtgagggccttcttgccgtgttacacatgatggtttttactgatgccctgcacagagagaggtctgtaaagtggcaagcaggagtctgctacaatggaggaaaggattttgctgtatctcttgccaggcccaaggctgcagagggaattggtaat

SEQ ID NO: 126116 - DNA, 6426 bp, Homo sapiens
  Payload ID: 4730
  Gene Symbol: DLEC1
  Gene Name: deleted in lung and esophageal cancer 1
  Uniprot ID: Q9Y238
  ENST ID: ENST00000308059
  CDS Start-End: 22-5289
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccagggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggccagcaggagccagccaaggccgctgtggccttcagggtctccccaaacagtgggctgctagaagcacgatccgccaatgcacccccaacctccatcgccttgcaggttttcttcactgccaggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatgcccattgcacttctcatccatggatttgccttgccttaagaattaaccatggccttgtggcctgggtgacccaggctgcttttatcttgcacagctaaagagggtctgatgggtggctcaacaccccacccactcctataccatgtcatcagtgttcacattttccaaatgagttgaagtgccttgatctgtccactgccaccaccaccagtgctgagttttcccatgtggttttgcttttgtggtgttactgccttgctgctagagcagcaggactgtctgcgtagcgcctccagcctgggacctcactcagttcccagggtattcaaagacggcagcggctcccattccagtcccgatgcacatggacaccactccgtatgccctgtgaaaacaaaacttaattggctgggcaaaggcacccaccaaattacctccagaccaggctgacccagaaggacgtcatggacaagtaggatgcaaaaccatcagaccagatctgtgggcaagcggtaccctggcctcccacttgggcacacacacggtgacagatgcccactgcaggctagtatccctttcaaggctggcccttaaggaaaacagggatcatgcccctacatcctaagttcagggtgtttctgtgtgcatgttcccctccccagggatcgatcataatcccaaaagacacaatcccaaacacaatcatcccaaatgttgaaatcctggaagaacaaaatccctaaagtctaaaatcctgaaaatcacaatcctaaaagatcaaaatcctgaaaatataattctggaaaaaataa

SEQ ID NO: 126117 - DNA, 5490 bp, Homo sapiens
  Payload ID: 4730
  Gene Symbol: DLEC1
  Gene Name: deleted in lung and esophageal cancer 1
  Uniprot ID: Q9Y238
  ENST ID: ENST00000346219
  CDS Start-End: 22-5358
gttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcagattcgggagctctataagcagcggctggatgagtttgaaatgttggagagacatatcactcaggcccaagcacgggctattgcggaaaatgagcgggtcatgagccaggctggagtacaggacctcgagagccttgtcaggttgcctccagtgaagagtgtctccagatggtgtatagacagcgagttgctacggaaacatcatttgatctccccagaagattactacaccgatacagtgccgtttcactctgcacctaaaggcatctccctacctggatgttcaaaactgacatttagctgtgagaagcgttccgtccagaagaaagagctgaacaagaagcttgaagattcatgcaggaagaagcttgctgagttcgaagatgagttagaccacactgtggacagcctgacatggaatttaactcctaaggccaaagaaaggaccagagaacctctcaagaaagcaagtcaaccaaggaataaaaactggatgaaccacttacgtgtgccacagagagagctagacagacttctgcttgccagaatggagagtcggaaccacttcctaaaaaatccccgtttttttcctcctaacactcgatatggaggcaagtctcttgtttttcctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactggggatgttcccaggaaaaggtggaatggtggctcctggaatgacctgccagtacattgtccagttttttcccgactgccttggggattttgatgattttattttagtggagacccagtcagcccacacacttctgatccccctgcaggcccggaggccgccccccgtgctgacattgtcaccggtgttggactgtggttactgcctcattgggggagtcaagatgaccagattcatctgcaaaaatgtgggtttcagtgttggcaggttctgcattatgcccaaaacaagctggccaccactaagtttcaaggccattgcaaccgtcggctttgttgaacaacctccttttggaatcctgccttcggtgtttgagctggccccgggacatgctatattagtggaggtcttgttttccccaaagagcctaggaaaggcagagcagaccttcatcatcatgtgcgacaactgccagataaaggagctggtgaccataggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacgcacgtggagctggccttctactggcagatcatgaagcccaacctgcagcccctcatgcctggagaaaccttcagcatggacagcatcaagtgctaccccgacaaggagactgccttctccatcatgcccagaaagggggttctaagcccccacacagaccacgagttcatcctgagcttttctcctcatgagctgagggattttcacagtgtgctccagatggtgctagaggaagtcccagagcctgtaagttcagaagcggagagcctggggcactcctcctactctgtggatgatgtgattgtcctggaaatcgaggtgaaaggctcagtagaacctttccaggttctcttagagccatatgccctcatcatcccaggggagaactacattgggataaatgtgaagaaggcttttaagatgtggaacaacagcaagtcacccatcagatacctgtgggggaagatcagcgactgccacatcattgaagtggagcccggcacaggggtcatagagcccagtgaggtcggggattttgagttgaactttactgggggtgtccctggccccacaagccaggacctgctgtgtgaaatcgaagactcgccctcgccagtggtgttacacattgaggctgtctttaaggggcctgccctcatcatcaacgtctcagcccttcagtttggtctgctccgcctggggcagaaagccacaaactccatccagatccggaacgtcagccagctcccagccacatggcgcatgaaggagagcccagtctccctccaggaaaggcctgaggatgtgtctcccttcgacattgagccttcgagtggccagcttcactctctgggggagtgcagggtggacatcaccttggaggccctgcactgccagcatctggagaccgtcctggagctggaggtggaaaatggtgcctggagctaccttcctgtgtatgctgaggtacagaagccccatgtgtacctacagagcagccaggtggaggttagaaatctctacctgggtgtgcccacgaagacaaccatcacacttatcaatggcacgctcctgcctacccagttccactggggcaagctcctcggacaccaagcagaattctgcatggtgacagtctcccccaaacatggcctgctgggcccaagtgaggagtgccagctcaagttggagttgactgctcatacccaggaagagctgacccatctggccctcccttgtcacgtgtcaggcatgaagaagccactggttctaggcatttctgggaagccccagggactgcaagtggccattaccatctctaaggagagctctgattgcagcacagagcagtggccaggccacccaaaggagctccgcctggactttggctcagcggtgccactgaggacccgtgtgactcgccagctcattctcaccaatcgctccccaatacggacccgtttctccctcaagtttgagtatttcgggagcccccaaaacagcctgagcaaaaagaccagccttcccaacatgcctcctgccctgctaaagacagtgcggatgcaagagcacctggccaagcgagagcagctggattttatggagagcatgctatcccacgggaaaggagctgctttcttccctcacttttcccagggcatgctggggccctaccagcagctgtgcattgacatcacaggctgtgccaacatgtggggcgagtactgggacaacctcatctgcacggtgggagacctgctgccggaagtcatcccagtgcacatggcagcggtgggctgccccatcagctccctgaggaccacctcctacactattgaccaggcccagaaggaaccagccatgaggttcggcacccaggtctccggaggagacacagttacccgaacccttcgcctgaataactccagcccctgtgacatccgcctggattgggagacctatgttccagaagacaaggaagaccggctggtggagctgctggtgttttatgggccacctttcccgctgcgggaccaagccgggaatgagcttgtgtgccctgatacccctgagggtggctgcctcctctggtccccaggcccctccagttcatcggaattcagccatgaaactgactcatcagttgagggcagctccagtgccagcaatagggtggcacagaagctcatctcagtcatcctgcaggcacatgagggggtgccctccggccacctgtactgtatcagccccaagcaggtggtggtccctgctgggggcagcagtaccatctacatctccttcacccctatggtgctcagccctgagatcctgcacaaggtggagtgtactggctacgccctgggtttcatgagcttggacagcaaggtggaaagggagattccagggaagaggcatcgcctgcaggactttgcggtgggacccctgaaactggacctgcatagctacgtgaggcctgcacagctaagtgtggagctggactacggcggcagtatggaattccagtgccaggccagtgacctcattcccgagcagccctgctctggggtgctgagtgagctggtgaccacccaccacctgaagctgaccaacactacagagatcccacactacttccggcttatggtctccaggcccttctccgtttctcaagatggggcgagccaggaccacagagctcctggccctggccagaagcaggagtgtgaggaggagacagcctcagcggacaagcagctggtgctccaagcacaggagaacatgctggtgaacgtgtccttctcactctccctggagctgctctcctatcagaagctcccagctgaccagacactgcctggggtggacattcagcagagtgcgagtggagagagagagatggtgtttactcagaacctgctcctggagtacaccaaccagaccactcaggtggtgcccctgcgggctgtggtggccgtgcctgagctgcagctctccaccagctgggtggactttgggacctgctttgtgagccagcagcgagtccgggaggtctacctgatgaacctgagcgggtgccgaagctactggactatgctgatgggagtagtgagctgtacgagtccacgatggtggtggaaggtgtgctcggtgagaagtcctgcaccctgcggctccggggccaaggctcctatgatgagagatacatgttgcctcaccagccctgaggctccgccccagccctcagccccaggccccagctggagaaaaaacattgcccagggattaggagcagctcttcagcacaaagacacagacttggggacctggggacctctgggcagctcctggaatggaagaacccccttccacaatggtctcagcctaggccctcatgatatgtcctcagagctaacataaaggacaggccacaccacagcagagaccaccacattgagatcactactcagtgcatagcgaagaccagtatggcaaaattagtcttggaaaaaaaccacagccactaagataaattcatgcacttttactatg

SEQ ID NO: 126118 - DNA, 533 bp, Homo sapiens
  Payload ID: 4730
  Gene Symbol: DLEC1
  Gene Name: deleted in lung and esophageal cancer 1
  ENST ID: ENST00000447130
  CDS Start-End: 1-249
cctccaaagaagccagcaccgataggagaattccagagtacagagccagaacagagttgtgctgatactccagtgtttctagctaagccaccaattgggtttttcacagattatgaaattggtccagtttatgagatggtaattgcgctgcagaacaccaccacgaccagccgctacctgcgagtcctcccgccttccacgccatacttcgctctgggactgggccattgcaaccgtcggctttgttgaacaacctccttttggaatcctgccttcggtgtttgagctggccccgggacatgctatattagtggaggaattgggcagctgattgctttggatctgatctatatttctggtgaaaaaagccagccagaccctggagagctcacagacttaacagcccagcacttcatacgatttgagcctgaaaaccttcggtccacggctaggaagcagctgattattagaaatgctacctgagggattttcacagtgtgctccagatggtgctagaggaagtcccagagcct

SEQ ID NO: 126119 - DNA, 981 bp, Homo sapiens
  Payload ID: 4731
  Gene Symbol: DLEU1
  Gene Name: deleted in lymphocytic leukemia 1 (non-protein coding)
  Uniprot ID: O43261
  ENST ID: ENST00000378180
  CDS Start-End: 267-503
gcacatgcgcagaatcatcgtggtgcacggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaa

SEQ ID NO: 126120 - DNA, 2955 bp, Homo sapiens
  Payload ID: 4731
  Gene Symbol: DLEU1
  Gene Name: deleted in lymphocytic leukemia 1 (non-protein coding)
  ENST ID: ENST00000469754
  CDS Start-End: 267-401
gcacatgcgcagaatcatcgtggtgcacggctctccctttgcttcttcggttgcagtcctcttgcttcttgcgcgtgcgtgtagcgcttttgcaaagccgcggaggtgaagtgaacttagaggttgtggggccgaggggtcgtcttatagctaccagcccacaggcatttagtctacgttggaggtaaacaaatacgggtcctgcttaggagaaaagaaaaacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccagatgaggacacctgaggttcagattaagaaatctgccccaaagtcttagaactgtgattctaccagaaaggaatgaagaacagaaccttcaggaattgagtcacaatgcagacaaatatcaaatgggagattgttgcaaggaagagattgatgatagtattttctactagccattgggaagataaaaggagacagaagattgaagcctttgccagccattctttccctttttgcttccaaactcctcaactgggaaccttcatatgtgcagtatttatattggatcatactggtgattataaaagttcctaggaggctagaagagccaaccaacagagaagggaaagcagtctgttctgaacatagggacataagttcattcatgccaagtatctttccagcatgtttctcccatttagaatatctagcatgtaaggcctttcaatattaatataagcccaatatcagctctttctctttgtatttcatctctttctactctcctatttgtattttgtgttcctatcaaagtgtcgtatctgggagatgacctgccttatcctgttctataacagttttgtttgctgctgtgtctttagaacagtgcctggcacacagtaagcactcaataaatctttgatgaatgaatgaatggttatcttttctctctggcaatccaaattcaccactccttaaaaattctacataagatttgctggctgggcgcagtgactcacgcctgtaatcccagcactttgggagactgagacaggtggatcacctgaggtcaggagtttgagaccagtctcaacatagcgaaaccccatctctactaaaagtacaaaaattagccgggcgtggtggcaggcgcctgtaatcccagctacttgggagactgaggcaggagaatcacttgagcccaggggggcagaggttgcagtgagctgagatcacgccacttcactccagcctgggcaaaagagcaaaactccgtctccaaaaaaaaaaaaaaaagatttgcctattccagcagacttctacccaatatcaatctagatttaaatcacttgattttccacatccctttagcaattatgtatagtttgcacttcattaacctacccttatttatgttacttctcacatacacccatatctcttctgtattttcaatcaaaagataatgcctcaaatgttatatatattgtatgtgccactcaacagtgcctcatatgctgcaaaaaaaaaagacagtaaacaatcggggtacctttttgtcttttaagccatattttctgggtcagtgtggtctttcaagggagtttagacaggctctattttttgttacttcactcctatagtatgtgactgtaaattgttccttcagtgttcaatttaagtacaaactaaagagaaacagtttcctaaagaaaaacattttaaagttacagagacacctatgtgttcgtaacatttctccagaaatatttgaagtaacgtaaaacttctggactggtcagtttaaatattttcttggaatttctatagaaatttctgtggaatggtgttatattggaaatattaattaactataagaagactcctacttcttcacagagaacaagcagggatatcctggattttcacagtatttaggccactccttaattgtctcatgaaggaattaaggtagtggaacacattcaagaattgcttaggtgtcaaaataagacaaagtgtaacagtttttttctgtagtagatttttaaatagttaaaagactctgccctctttatctatactgtattctggcaataataaagttgggcagcctatacataaaagcaatttctaacaatgccaaattaacagcagtttcttggccctttcctttccctccatgaaagttacaatattaggttatttcacaggtttcctccatgccccccatacccaacctaaaactgtgttaggctgtcaaagaaaacaaatcaggtaagattagtgtttgcctttacgcagtcattctaagtacacataaaatcatacataatatgaaaatacagcaggaagagaaacatcaaaccatagaactgagttttagttttactgacatttatatggcatacttcctgtttttgatttcagaagtgcaaccatgcagtgcttctatgaaaaactgaatagttgagtacagtttgaggattataacaacttatccaaaggaaacaaacagacctaacttactgctgttttcatttgtggaactgctatctttgttgtaaaaagttgagtatttttcaaacatcatttaataatagggtagcccctaaaacaagtaaggagctataagtctgagttgtgaatttgactagtaatggaataagaaaaccaagccaaactccatctaaatatgtatgtaaaggtaatgcttgtaaaaatttgctttttcctcattttgagatttcagttgccagttgactattggtatgcaaaattaacaattctgcctaaaggaggtaaacgatagaggttaattcttaaataaaagtccctttgtttcactatt

SEQ ID NO: 126121 - DNA, 2092 bp, Homo sapiens
  Payload ID: 4732
  Gene Symbol: DLEU7
  Gene Name: deleted in lymphocytic leukemia, 7
  Uniprot ID: Q6UYE1
  ENST ID: ENST00000400393
  CDS Start-End: 294-776
ctggagagagggaagaagcaacgctcagcatttcgctgattttcaagtgcacaccgagcagcgcttcaggcagctttgggtcagaacacgcctgattcggacttcaggcgaaggcagaggccagcacgggtcaccgattcagagccgggggcggggccgaccacacacgctgtgagacccagaggccgaggagccgcgggttagaaaatgtgaccttggcgaccccaacgcccccgcctccctcgctgctgctccacctgcacgcggagcgcgccgggccgccagcggaggcgatggccagccctgcgcccttagtggcctccatcagccaccaaatggtggctctgcagaccttgcagctgctgcagcaggagtggggctggggggacggtccagtcgcccccgggaacccgcgggacccagaccacgtgtccaccgctccagcccgtcgctcaggcccgccgcgggcccggccggggcccgggcgcgaggagcggggcgggggcgtggggaccaggagtcggcggaccgcggcgcgggcgaactccccagaggaggaggtagtgcgaggcgctgaggggggcgccgagttgctgcccttcccccgggaccgcgggccctgcaccctggcccagatggcgatgcgcagcgcgctggcccgcgtggtggactcgacttcggagctggtcagcgtggagcagacgctgctggggcccctccagcaggagcggtcctttcccattcacctgaagcttcaactcctggctaatgagtgaagaaggtcactgtaggagtgtgaggaccatcaggagcttcatatttcaataaccagtgccaaattctgaatgccagatgggatgagatgggatgttaaaccacttcttattaccacgttgttggcctccattgccttcgtattggtctccaattgcatggtctctgtggatctctgacttcttattacctccgattggaacgcgccacaaatcatcctgctttctttatcctctctcacctccaagtaatcctgtcatcttgctccaattagagccgcttccattaagaagatcgtgacaaattccctacccctgtttgctcttcaggaaaattatcccctggaaaagtggatgttatagtcgcttttcagaatgtattgtctgaatttcttgtcttccaacattctcctaagccagttacctttgcactgaagtagaattcaaaaggagatagaggttctgaatttcttcctttgaccagatggaagtcgttacatcagaatgctgatgactgcaaaatcttggacatattgttttcacaattaggaaatggcaaacacaaagttcttcagtgcaaagccagcatgcgagttcagcttccatttgctgctataaattttgttcttgttgctgccagtaaacaccaactgttcaagtgaaatagtaaatccaaatgtgcctgttggatgagagtaaaaaaattatatgctgcataaatgctgatgcaaaaggatttttcaacacactaaaccagggtagggaaaggaaccgagaaagaaagttgaactgaatgcagctctcactaacaacttcttggtaaaagcactaaaaaagctcttgatagaatgttgattcaacatactgtttaaacctcaaggaaaaaaacaaacgcagaattgggatattggccttaggatatctgcttaaagtcctactttgagctctcatcagggttaccaaagaaggcgtacatagattgttacaaatcaaagcaaagaaaaatcccaaagttccctcaaaactgatgtgggcacttggcccagaagttgtttgctaatgatcagtctaacagctgaaagtcaaagtcagtggctagtaccatctgcaataggatttaggaagttttgatctcacaaatttactgtaaggctaatcaatgaatgtttgtactcaggtctccctacagttaaatttaatgtgtaactggaattacgattcaaagagatagtttcataaatggtccctgaaatttaattttggattacctaagtttacaatggatttctcttctcctttccccaatatttttcttacgc

SEQ ID NO: 126122 - DNA, 1122 bp, Homo sapiens
  Payload ID: 4732
  Gene Symbol: DLEU7
  Gene Name: deleted in lymphocytic leukemia, 7
  Uniprot ID: Q6UYE1
  ENST ID: ENST00000504404
  CDS Start-End: 51-716
cgctgctgctccacctgcacgcggagcgcgccgggccgccagcggaggcgatggccagccctgcgcccttagtggcctccatcagccaccaaatggtggctctgcagaccttgcagctgctgcagcaggagtggggctggggggacggtccagtcgcccccgggaacccgcgggacccagaccacgtgtccaccgctccagcccgtcgctcaggcccgccgcgggcccggccggggcccgggcgcgaggagcggggcgggggcgtggggaccaggagtcggcggaccgcggcgcgggcgaactccccagaggaggaggtagtgcgaggcgctgaggggggcgccgagttgctgcccttcccccgggaccgcgggccctgcaccctggcccagatggcgatgcgcagcgcgctggcccgcgtggtggactcgacttcggagctggtcagcgtggagcagacgctgctggggcccctccagcaggagcggtcctttcccattcacctgaaggatagtgttgagtttagaaacatctgcagtcatttggctctacagattgaaggacagcagtttgacagagacttgaatgctgcccaccagtgtttgaagacaatagtcaagaagctgattcagtcacttgctaattttccttcagatgcccacatggtagcctgtgcttccttgagacagatcttacagaatctcccagacatatgagtgttaaaggcatcgggagtaaaaccacagccagcactgttaagagaaccagataccttaccttcctaattgagtcagcagacaatggatatttttatatccaaaggggaaagacttgatggtacgtggagcagtctgaccagtggcatctgtagccttcgggattatagcatgttaatgaaatttttttaaagcagtagttcatatttttaagtatattgacctatttgctgactttctgattgaaatacattctactttgtgaagctgatttgattatgtatgtatatatttattcatattattagtttttattgaatgataccttaatttgtattcatattaatgtaggtctaaagggtttaatgtggttatttatataattaaagttccatggttcttaaaa

SEQ ID NO: 126123 - DNA, 5802 bp, Homo sapiens
  Payload ID: 4733
  Gene Symbol: DMBT1
  Gene Name: deleted in malignant brain tumors 1
  Uniprot ID: Q9UGM3
  ENST ID: ENST00000330163
  CDS Start-End: 107-5464
tttatagcagcagtagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacatgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 126124 - DNA, 7686 bp, Homo sapiens
  Payload ID: 4733
  Gene Symbol: DMBT1
  Gene Name: deleted in malignant brain tumors 1
  Uniprot ID: Q9UGM3
  ENST ID: ENST00000338354
  CDS Start-End: 107-7348
tttatagcagcagtagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacatgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 126125 - DNA, 7656 bp, Homo sapiens
  Payload ID: 4733
  Gene Symbol: DMBT1
  Gene Name: deleted in malignant brain tumors 1
  Uniprot ID: Q9UGM3
  ENST ID: ENST00000344338
  CDS Start-End: 107-7318
tttatagcagcagtagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctgcccagcctcagtcaacactcaggccagaaagttggcctgtcaggatatcaccacctgtacccacagaaggatctgaatccagtttggccctgaggctggtgaatggaggcgacaggtgtcgaggccgagtggaggtcctataccgaggctcctggggcaccgtgtgtgatgactactgggacaccaatgatgccaatgtggtctgcaggcagctgggctgtggctgggccatgtcagccccaggaaatgcccagtttggccagggctcaggacccattgtcctggatgatgtgcgctgctcaggacatgagtcctacctgtggagctgcccccacaatggctggctcacccacaactgtggccatagtgaagacgctggtgtcatctgctcagctccccagtcccggccgacacccagcccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagacacgttgccgaccatcaccttacctgcatcgacagtaggatctgaatccagtttggccctgaggctggtgaatggaggtgacaggtgtcagggccgagtggaggtcctataccgaggctcctggggcaccgtgtgtgatgacagctgggacaccaatgatgccaatgtggtctgcaggcagctgggctgtggctgggccatgttggccccaggaaatgcccggtttggtcagggctcaggacccattgtcctggatgacgtgcgctgctcagggaatgagtcctacttgtggagctgcccccacaatggctggctctcccataactgtggccatagtgaagacgctggtgtcatctgctcaggacctgaatccagtttggccctgaggctggtgaatggaggtgacaggtgtcagggccgagtggaggtcctataccgaggctcttggggcaccgtgtgtgatgacagctgggacaccaatgatgccaatgtggtctgcaggcagctgggctgtggctgggccacgtcagccccaggaaatgcccggtttggtcagggctcaggacccattgtcctggatgatgtgcgctgctcaggacatgagtcctacctgtggagctgccccaacaatggctggctctcccacaactgtggccatcatgaagatgctggtgtcatctgctcagctgcccagtcccggtcgacgcccaggccagacacgttgtcgaccatcacgttacctccatcgacagtaggatctgaatccagtttgaccctgaggctggtgaatggaagtgacaggtgtcagggccgagtagaggtcctataccgaggctcctggggcaccgtgtgtgatgacagctgggataccaatgatgccaatgtggtctgcaggcagctgggctgtggctgggccacgtcggccccaggaaatgcccggtttggccagggctcaggacccattgttctggatgatgtgcgctgctcaggacacgagtcctacctgtggagctgcccccacaatggctggctctcccacaactgtggccatcatgaagatgctggtgtcatctgctcagtttcccagtcccggccgacacccagtccagatacttggccgacctcacatgcatcaacagcaggacctgaatccagtttggccctgaggctggtgaatggaggtgacaggtgtcagggccgagtggaggtcctataccgaggctcctggggcaccgtgtgtgatgatagctgggacaccagtgacgccaatgtggtctgccggcagctgggctgtggctgggccacgtcagccccaggaaatgcccggtttggccagggttcaggacccattgtcctggatgacgtgcgctgctcaggctatgagtcctacctgtggagctgcccccacaatggctggctctcccataactgtcagcacagtgaagacgctggtgtcatctgctcagctgcccactcctggtcgacgcccagtccagacacattgccgaccatcaccttgcctgcatcgacagtaggatctgaatccagtttggccctgaggctggtgaatggaggtgacaggtgtcagggccgagtggaggtcctataccaaggctcctggggcaccgtgtgcgatgacagctgggacaccaatgatgccaatgtcgtctgcaggcaactgggctgtggctgggccatgtcagccccaggaaatgcccggtttggtcagggctcaggacccattgtcctggatgatgtgcgctgctcaggacacgagtcttacctgtggagctgcccccacaatggctggctctcccacaactgtggccatagtgaagacgctggtgtcatctgctcagcttcccagtcccggccaacacctagtccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccatgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagctgctcagtcccagtcaacgcccaggccagatacttggctgaccaccaacttaccggcattgacagtaggatctgaatccagtttggctctgaggctggtgaatggaggtgacaggtgtcgaggccgagtggaggtcctgtatcgaggctcctggggaaccgtgtgtgatgacagctgggacaccaatgatgccaatgtggtctgcaggcagctgggctgtggctgggccatgtcggccccaggaaatgcccggtttggccagggctcaggacccattgtcctggatgatgtgcgctgctcagggaatgagtcctacctgtggagctgcccccacaaaggctggctcacccacaactgtggccatcacgaagacgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 126126 - DNA, 3846 bp, Homo sapiens
  Payload ID: 4733
  Gene Symbol: DMBT1
  Gene Name: deleted in malignant brain tumors 1
  Uniprot ID: Q9UGM3
  ENST ID: ENST00000359586
  CDS Start-End: 107-3508
tttatagcagcagtagaaatataccaccctagaggacacacctccttttagctaggtacctataaatgtccaggattttctattcaattgagaagaacccagcaaaatggggatctccacagtcatccttgaaatgtgtcttttatggggacaagttctatctacaggtgggtggatcccaaggactacagactacgcttcactgattccctcggaggtgcccttggatccaactgtagcagaaggttctccatttccctcggagtcgaccctggagtcaactgtagcagaaggttctccgatttccttggagtcaaccctggagtcaaccgtagcagaaggttctctgattccctcagagtcaaccctggagtcaactgtagcagaaggatctgattctggtttggccctgaggctggtgaatggagatggcaggtgtcagggccgagtggagatcctataccgaggctcctggggcaccgtgtgtgatgacagctgggacaccaatgatgccaacgtggtctgtaggcagctgggttgtggctgggccatgtcagctccaggaaatgcctggtttggccagggctcaggacccattgccctggatgatgtgcgctgctcaggacacgaatcctacctgtggagctgcccccacaatggctggctctcccataactgtggccatggtgaagatgctggtgttatctgctcagctccccagtcccggccgacacccagcccagatacttggccgacctcacatgcatcaacagcaggatctgaatccagtttggccctgaggctggtgaatggaggtgacaggtgtcagggccgagtggaggtcctataccgaggctcctggggcaccgtgtgtgatgactactgggacaccaatgatgccaatgtggtttgcaggcagctgggctgtggctgggccacgtcagccccaggaaatgcccggtttggccagggttcaggacccattgtcctggatgatgtgcgctgctcaggacatgagtcctatctgtggagctgcccccacaatggctggctctcccacaactgtggccatcatgaagacgctggtgtcatctgctcagcttcccagtcccagccgacacccagcccagacacttggccaacctctcgtgcatcaacagcaggatctgaatccactttggccctgagactggtgaatggaggtgacaggtgtcgaggccgagtggaggtcctataccaaggctcctggggcaccgtgtgtgatgactactgggacaccaatgatgccaacgtggtctgcaggcagctgggctgtggctgggccatgtcagccccaggaaatgcccagtttggccagggctcaggacccattgtcctggatgatgtgcgctgctcaggacacgagtcttacctgtggagctgcccccacaatggctggctctcccacaactgtggccatcatgaagatgctggtgtcatctgctcagccacccaaataaattctactacgacagattggtggcatccaacaactacaaccactgcaagaccctcttcaaattgtggtggcttcttattctatgccagtgggacattctccagcccatcctaccctgcatactaccccaacaatgctaagtgtgtttgggaaatagaagtgaattctggttatcgcataaacctgggcttcagtaatctgaaattggaggcacaccataactgcagttttgattatgttgaaatctttgatggatcattgaatagcagtctcctgctggggaaaatctgtaatgataccaggcaaatatttacatcttcttacaaccgaatgaccattcactttcgaagtgacatcagtttccaaaacactggctttttggcttggtataactccttcccaagcgatgccaccttgaggttggtcaatttaaattcatcctatggtctatgtgccgggcgtgtagaaatttaccatggtggcacctgggggacagtttgtgatgactcctggaccattcaggaagctgaggtggtctgcagacagctagggtgtggacgtgcagtttcagcccttggaaatgcatattttggctctggctctggccccatcaccctggacgatgtagagtgctcagggacggaatccactctctggcagtgccggaaccgaggctggttctcccacaactgtaatcatcgtgaagatgctggtgtcatctgctcaggaaaccatctatcgacacctgctccttttctcaacatcacccgtccaaacacagattattcctgcggaggcttcctatcccaaccatcaggggacttttccagcccattctatcccgggaactatccaaacaatgccaagtgtgtgtgggacattgaggtgcaaaacaactaccgtgtgactgtgatcttcagagatgtccagcttgaaggtggctgcaactatgattatattgaagttttcgatggcccctaccgcagttcccctctcattgctcgagtttgtgatggggccagaggctccttcacttcttcctccaacttcatgtccattcgcttcatcagtgaccacagcatcacaaggagagggttccgggctgagtactactccagtccctccaatgacagcaccaacctgctctgtctgccaaatcacatgcaagccagtgtgagcaggagctatctccaatccttgggcttttctgccagtgaccttgtcatttccacctggaatggatactacgagtgtcggccccagataacgccgaacctggtgatattcacaattccctactcaggctgcggcaccttcaagcaggcagacaatgacaccatcgactattccaacttcctcacagcagctgtctcaggtggcatcatcaagaggaggacagacctccgtattcacgtcagctgcagaatgcttcagaacacctgggtcgacaccatgtacattgctaatgacaccatccacgttgctaataacaccatccaggtcgaggaagtccagtatggcaattttgacgtgaacatttccttttatacttcctcatctttcttgtatcctgtgaccagccgcccttactacgtggacctgaaccaggacttgtacgttcaggctgaaatcctccattctgatgctgtactgaccttgtttgtggacacctgcgtggcatcaccatactccaatgacttcacgtctttgacttatgatctaatccggagtggatgcgtgagggatgacacctacggaccctactcctcgccatctcttcgcattgcccgcttccggttcagggccttccacttcctgaaccgcttcccctccgtgtacctgcgttgtaaaatggtggtgtgcagagcgtatgacccctcttcccgctgctaccgaggctgtgtgttgaggtcgaagagggatgtgggctcctaccaggaaaaggtggacgtcgtcctgggtcccatccagctgcagacccccccacgccgagaagaggagcctcggtaggtggtcgctctcagaccccactgtccaccggggcgcagacccctgactcggggacttgggatgttcctcttggtgtcatattccaactcagattgagccctacattgtgctgcacctggtcatacggagttgaatcagacctggttcccgcctcccccaaggctcatggtccttggaggacccgttgcagggtgaggtcaagagagttctgacctggatggcccatagacctgacgtcccagaatccatgcttctcatctgcaaaatgaaaatgtcaatacttacttcttagcactgttgagagggttacttacataaaggaattttggtgaaactgc

SEQ ID NO: 126127 - DNA, 7686 bp, Homo sapiens; identical to SEQ ID NO: 126124
  Payload ID: 4733
  Gene Symbol: DMBT1
  Gene Name: deleted in malignant brain tumors 1
  Uniprot ID: Q9UGM3
  ENST ID: ENST00000368909
  CDS Start-End: 107-7348

SEQ ID NO: 126128 - DNA, 7656 bp, Homo sapiens; identical to SEQ ID NO: 126125
  Payload ID: 4733
  Gene Symbol: DMBT1
  Gene Name: deleted in malignant brain tumors 1
  Uniprot ID: Q9UGM3
  ENST ID: ENST00000368955
  CDS Start-End: 107-7318

SEQ ID NO: 126129 - DNA, 5802 bp, Homo sapiens; identical to SEQ ID NO: 126123
  Payload ID: 4733
  Gene Symbol: DMBT1
  Gene Name: deleted in malignant brain tumors 1
  Uniprot ID: Q9UGM3
  ENST ID: ENST00000368956
  CDS Start-End: 107-5464

SEQ ID NO: 126130 - DNA, 7686 bp, Homo sapiens; identical to SEQ ID NO: 126124
  Payload ID: 4733
  Gene Symbol: DMBT1
  Gene Name: deleted in malignant brain tumors 1
  Uniprot ID: Q9UGM3
  ENST ID: ENST00000619379
  CDS Start-End: 107-7348

SEQ ID NO: 126131 - DNA, 641 bp, Homo sapiens
  Payload ID: 4734
  Gene Symbol: DPCD
  Gene Name: deleted in primary ciliary dyskinesia homolog (mouse)
  ENST ID: ENST00000370147
  CDS Start-End: 13-525
agcaggggaaagatggcggtgacgggctggttggagagtctgcggacagcccagaagactgcgctgctgcaggacgggagaaggaaggttcactatttattcccagacggcaaggaaatggctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaagcggactggttggaggcttctctggacccctctggccatgcggtgtgcaggtgtgcatggcaccccctctgagatagacaccagctacctctggatgacgccttgctgagctttgcccacgccaactgcaccctgatcatctcttaccagaagccaaaggaggttgtggtggccgagtctgagctacagaaggaactaaagaaggtgaagacagcccacagcaac

SEQ ID NO: 126132 - DNA, 858 bp, Homo sapiens
  Payload ID: 4734
  Gene Symbol: DPCD
  Gene Name: deleted in primary ciliary dyskinesia homolog (mouse)
  Uniprot ID: Q9BVM2
  ENST ID: ENST00000370151
  CDS Start-End: 50-661
ggaacggttgccatggcagcggctgggcgtgctgcttagcaggggaaagatggcggtgacgggctggttggagagtctgcggacagcccagaagactgcgctgctgcaggacgggagaaggaaggttcactatttattcccagacggcaaggaaatggctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaagtactacaagaagttctccattcctgatctagatagacaccagctacctctggatgacgccttgctgagctttgcccacgccaactgcaccctgatcatctcttaccagaagccaaaggaggttgtggtggccgagtctgagctacagaaggaactaaagaaggtgaagacagcccacagcaacgatggggactgcaagacccagtagttggcccctgagccttatacctccaccacagggggtgccgtgagacttcaaggcttggcccttcttgaccacggcagcctcctgtcttctaggagctatcaagggtctctaagaactgggcatggggcactcctagccagtgagtcatggtcatatttcctgagtaaagtcattctgagttacttactgcacaggga

SEQ ID NO: 126133 - DNA, 369 bp, Homo sapiens
  Payload ID: 4734
  Gene Symbol: DPCD
  Gene Name: deleted in primary ciliary dyskinesia homolog (mouse)
  ENST ID: ENST00000434727
  CDS Start-End: 1-351
gctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaataccagaagccaaaggaggttgtggtggccgagtctgagctacagaaggaactaaagaaggtgaagacagccc

SEQ ID NO: 126134 - DNA, 541 bp, Homo sapiens
  Payload ID: 4734
  Gene Symbol: DPCD
  Gene Name: deleted in primary ciliary dyskinesia homolog (mouse)
  ENST ID: ENST00000626968
  CDS Start-End: 29-541
gctgggcgtgctgcttagcaggggaaagatggcggtgacgggctggttggagagtctgcggacagcccagaagactgcgctgctgcaggacgggagaaggaaggttcactatttattcccagacggcaaggaaatggctgaagaatatgacgagaagacgagtgaactacttgtgagaaagtggcgtgtgaaaagtgccctgggagccatgggccagtggcagcttgaagtaggagacccagcgcccctaggagcagggaacctggggcctgaactcatcaaggaaagcaatgccaatcctatcttcatgcgcaaggacaccaagatgagtttccagtggcggattcgaaacctcccctatcctaaggatgtctatagtgtctctgtggaccagaaggagcgctgcatcattgtcagaacaaccaacaagaagcggactggttggaggcttctctggacccctctggccatgcggtgtgcaggtgtgcatggcaccccctctgagatagacaccagctacctctggatgacgccttgctga

SEQ ID NO: 126135 - DNA, 2101 bp, Homo sapiens
  Payload ID: 4735
  Gene Symbol: DEGS1
  Gene Name: delta(4)-desaturase, sphingolipid 1
  Uniprot ID: O15121
  ENST ID: ENST00000323699
  CDS Start-End: 167-1138
ggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttccaccattcaaa

SEQ ID NO: 126136 - DNA, 1345 bp, Homo sapiens
  Payload ID: 4735
  Gene Symbol: DEGS1
  Gene Name: delta(4)-desaturase, sphingolipid 1
  Uniprot ID: O15121
  ENST ID: ENST00000391877
  CDS Start-End: 72-1043
gccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatc

SEQ ID NO: 126137 - DNA, 957 bp, Homo sapiens
  Payload ID: 4735
  Gene Symbol: DEGS1
  Gene Name: delta(4)-desaturase, sphingolipid 1
  ENST ID: ENST00000415210
  CDS Start-End: 174-957
gccgggagaggacgccggagggaaaggaagggggagcgcgcccagcatcgcttgggcctcctccacccgctcaggaggggaaacaggagagccgggagcacaacagcctcgcgcgcccgccgccgcctcagccttaggggaggccactacgcctctggttacatttcttgatcatggtatctccccagctagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaat

SEQ ID NO: 126138 - DNA, 4352 bp, Homo sapiens
  Payload ID: 4736
  Gene Symbol: DEGS2
  Gene Name: delta(4)-desaturase, sphingolipid 2
  Uniprot ID: Q6QHC5
  ENST ID: ENST00000305631
  CDS Start-End: 577-1548
cgggtggaggaagggaggattgctgcaccaacctttcctcggcgcctgtttactggcaccgtcgcatccattccacgccgatcctccgcagtccccctatcctgccagccgctcctccttggggcaggggcggcgcgagccacaggggcgtgcccgcgagcgggtcggggctgcggagagaacgggccggggtaaaaacccgacggctgcccgcgggtgggcggggcgcgcagagccggtgggaggccgcggtggcagcagtcgcccccgcgcatcgagggacccagggactcgcgcagatggcacgcggccacctcggtcctgccggggagccccatttccaaccgaggcaactgaggttcccaaagcgccagctacccgccggggtctggagagcgccggggcccggccgccccgcccagccagaggtgccccgccccaagcctggcgcacctggccccgccccgccgggaccccgcccccgccctaatcagagctggttccgcgccgcggccgccgcgacaggtgcagcagagccgagccggccgcgctccgaacggcgcctcccgccccaccatgggcaacagcgcgagccgcagcgacttcgagtgggtctacaccgaccagccgcacacgcagcggcgcaaggagatactggccaagtacccggccatcaaggccctgatgcggccagacccgcgcctcaagtgggcggtgctggtgctggtgctggtgcagatgctggcctgctggctggtgcgcgggctggcctggcgctggctgctgttctgggcctacgcctttggtggctgcgtgaaccactcgctgacgctggccatccacgacatctcgcacaacgcggccttcggcacgggccgtgcggcacgcaaccgctggctggccgtgttcgccaacctgcccgtgggtgtgccctacgccgcctccttcaagaagtaccacgtggaccaccaccgctacctgggcggcgacgggctggacgtggacgtgcccacgcgtctggagggctggttcttctgcacacccgcccgcaagctgctctggctggtgctgcagcccttcttctactcactacggccgctctgcgtccaccccaaggccgtgacccgcatggaggtgctcaacacgctggtgcagctggcggccgacctggccatctttgccctttgggggctcaagcccgtggtctacctgctggccagctccttcctgggcctgggcctgcaccccatctcgggccacttcgtggccgagcactacatgttcctcaagggccacgagacctactcctactatgggcctctcaactggatcaccttcaatgtgggctaccacgtggagcaccacgacttccccagcatcccgggctacaacctgccgctggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccgggctgcctcctggtggtggccattgtcccccatcggcccctcagccttgcaccccagcactgagaagctacatttccttcctgtgctctggactgctgcccttgtccccgaggagtgtcccgcgcagccacacctggcaacagcagtgtgggctgcagggctccgtctgcacgtggacttgccctggaccttgagtgtggccctccctttctgggcctccccaggtgaggcctggccctgccccaccatgacctgggtgctctgagcccacggttcccacggagctgacttctccggggtgcctgtgccctacattaaacccggcgtttgtttcacagcccatggattgtgcttctgagggggtggtctgggcttgagcctggccccagggaatggggcgctgggccgccccgatgagtggagcttgaggcctgagtgccgcttcgtccaggccaggcccaggtcctgccatgcactcctggctctttgtgggacggtggctgctgctggcagtgctccctcagggcctgccactgtggtgtgcacacacactgaggtgtggacagcagaaagctcactttggtcatctgtgtggctccaaatccctcctagcagcccggggatcccacggctcccttgcctggctgagccacgcagaggctggctcccccatccccctgagcccacaccacctgccttgcccccaccccttgggcctgctcacctcctgctctctgtatgccctcccgcggcagggagcgtccctgagcccagagagggtctatcccccacaccagctcggaggaggggctggaggagctctgcccagatctggcacccaagcccgggggctggccgggcaggtgactgtcctggtgagccacagctcagatgggatgcgggtcgggcagcgtcctgggagtgtgcgtgacgtgagacgtgtcggtcctttctacagaagggctgagggtgcagctgcgacctaggaggttgtcttctcctggagggcagggctgggttgggtcctgatgtcccagaggtgggcaggcagcaggaggggtgcctgagcgaggaggccctccctgccagagagggatggagcgggcccactgcaatccagcagtggatgcagctcccaccactgccttggggaaggcggcctcagcctccaggacttaggaatggagactgaggctacagtcagggcttgaaggcctctccatgagtggggtgccaggggctgtccctgctgacctgggagatgcaggtctccccctatacctgggagtggccccgcacagcgccggcctcccatgtccgagtgggcagcctgctgagtggcgcagggaagaggcctgagcccaggacttgttctgcaaaggaagtgctgctggccccggcaccaggactttgagccgggcggcccctccctgtgcacacaggcccgcccacaggctgaggggaacccagagcacccgctcctcctgctgtgcctgagggggtgcctcgttcagcacacttttctgcagacagcgcaaaggggcatgtccaggcctcacccacaaactgaaggccaggcccagggtcagagggtggctccgaagacagacagtcctttgagcgctcctggggagactcctggccttggggggagccctcctggcctggggggcggcagggaagcgggagagagcagctctgagctgtggtctgcaggccctgggttaaaagtgccaccagacctaggtgaagcctaggcgaagccactcagagagtggagcctcctaaggggcagagcagtcatattcctgttgctagggctgccgggaagcccaacaacgtgcagtgtgctaggagccggcccttgagatcagccactgggtcccagcaggcagtgccggctccctcccctgccatggcccttgggggctgctgggcacactgctctgtggctgcaggaggtcatgtgggagaactgggggcatgagtggtcacaggatctcaaggcctgcctgttggtggccctggttccttgaagctgagggtcagaacctctgtctctggctgctgcctcagggcaggggcctgggacagcccattgcaggccaggtggtcctcccaggagactttgtggggccgaggagaaggcaaagctgccttgcatttgcctggtgcctgctaagccccaagtccatccctcccctgaacaggacgctcgcagggccctgcccgtcagaatgcacgtggagtcctctgaggttcgggggtgtgggttgcacttgagggaccatcttcctggagatcccgtagggagttccctacaggcaggacctgaggcccagccccaggacaccaccccaccttcccggggcttgggaatgttctgagcccagcttcctgtcgaagaccgccatcttgctcctacgactcctggtcaccgtggtcccgggcccttctctgaaaaggggcatccccagcccggagcgtgatggaccaatgcgagggcctgagcccgagggtgcggacagtaaaccgtttattactgtgtggacacagacaccgtggtgcatgacagacagtttcaacaccatgagcgctggggacggagctgtgcctggacagctctgcggtgtgtggtggcgccacgctgggccggctgtcaccgccagctgaggcgctaacagcgtcacctgggagaaaacctggaaaccgtctaatgaagcaggtgacttaggggcgtctctagaaacccaaagaaatgtaccttaaataagcaaatataaaacacaaaaaagacga

SEQ ID NO: 126139 - DNA, 421 bp, Homo sapiens
  Payload ID: 4736
  Gene Symbol: DEGS2
  Gene Name: delta(4)-desaturase, sphingolipid 2
  ENST ID: ENST00000553834
  CDS Start-End: 9-173
gccccaccatgggcaacagcgcgagccgcagcgacttcgagtgggtctacaccgaccagccgcacacgcagcggcgcaaggagatactgggtgcggaagatcgcgcccgagtactacgaccacctgccgcagcaccactcctgggtgaaggtgctctgggattttgtgtttgaggactccctggggccctatgccagggtgaagcgggtgtacaggctggcaaaagatggtctgtgagcccgggctgcctcctggtggtggccattgtcccccatcggcccctcagccttgcaccccagcactgagaagctacatttccttcctgtgctctggactgctgcccttgtccccgaggagtgtcccgcgcagccacacctggcaacagcagtgtgggctgcagggctccgtctgcacgtggact

SEQ ID NO: 126140 - DNA, 3260 bp, Homo sapiens
  Payload ID: 4737
  Gene Symbol: DNER
  Gene Name: delta/notch-like EGF repeat containing
  Uniprot ID: Q8NFT8
  ENST ID: ENST00000341772
  CDS Start-End: 136-2349
cgcagctgcaggaggcgcccggcccggcggagcagccctagccgccaccgtcgctctcgcagctctcgtcgccactgccaccgccgccgccgtcactgcgtcctggctccggctcccgcgccctcccggccggccatgcagccccgccgcgcccaggcgcccggtgcgcagctgctgcccgcgctggccctgctgctgctgctgctcggagcggggccccgaggcagctccctggccaacccggtgcccgccgcgcccctgtctgcgcccgggccgtgcgccgcgcagccctgccggaatgggggtgtgtgcacctcgcgccctgagccggacccgcagcacccggcccccgccggcgagcctggctacagctgcacctgccccgccgggatctccggcgccaactgccagcttgttgcagatccttgtgccagcaacccttgtcaccatggcaactgcagcagcagcagcagcagcagcagcgatggctacctctgcatttgcaatgaaggctatgaaggtcccaactgtgaacaggcacttcccagtctcccagccactggctggaccgaatccatggcaccccgacagcttcagcctgttcctgctactcaggagcctgacaaaatcctgcctcgctctcaggcaacggtgacactgcctacctggcagccgaaaacagggcagaaagttgtagaaatgaaatgggatcaagtggaggtgatcccagatattgcctgtgggaatgccagttctaacagctctgcgggtggccgcctggtatcctttgaagtgccacagaacacctcagtcaagattcggcaagatgccactgcctcactgattttgctctggaaggtcacggccacaggattccaacagtgctccctcatagatggacgaagtgtgaccccccttcaggcttcagggggactggtcctcctggaggagatgctcgccttggggaataatcactttattggttttgtgaatgattctgtgactaagtctattgtggctttgcgcttaactctggtggtgaaggtcagcacctgtgtgccgggggagagtcacgcaaatgacttggagtgttcaggaaaaggaaaatgcaccacgaagccgtcagaggcaactttttcctgtacctgtgaggagcagtacgtgggtactttctgtgaagaatacgatgcttgccagaggaaaccttgccaaaacaacgcgagctgtattgatgcaaatgaaaagcaagatgggagcaatttcacctgtgtttgccttcctggttatactggagagctttgccagtccaagattgattactgcatcctagacccatgcagaaatggagcaacatgcatttccagtctcagtggattcacctgccagtgtccagaaggatacttcggatctgcttgtgaagaaaaggtggacccctgcgcctcgtctccgtgccagaacaacggcacctgctatgtggacggggtacactttacctgcaactgcagcccgggcttcacagggccgacctgtgcccagcttattgacttctgtgccctcagcccctgtgctcatggcacgtgccgcagcgtgggcaccagctacaaatgcctctgtgatccaggttaccatggcctctactgtgaggaggaatataatgagtgcctctccgctccatgcctgaatgcagccacctgcagggacctcgttaatggctatgagtgtgtgtgcctggcagaatacaaaggaacacactgtgaattgtacaaggatccctgcgctaacgtcagctgtctgaacggagccacctgtgacagcgacggcctgaatggcacgtgcatctgtgcacccgggtttacaggtgaagagtgcgacattgacataaatgaatgtgacagtaacccctgccaccatggtgggagctgcctggaccagcccaatggttataactgccactgcccgcatggttgggtgggagcaaactgtgagatccacctccaatggaagtccgggcacatggcggagagcctcaccaacatgccacggcactccctctacatcatcattggagccctctgcgtggccttcatccttatgctgatcatcctgatcgtggggatttgccgcatcagccgcattgaataccagggttcttccaggccagcctatgaggagttctacaactgccgcagcatcgacagcgagttcagcaatgccattgcatccatccggcatgccaggtttggaaagaaatcccggcctgcaatgtatgatgtgagccccatcgcctatgaagattacagtcctgatgacaaacccttggtcacactgattaaaactaaagatttgtaatctttttttggattatttttcaaaaagatgagatactacactcatttaaatatttttaagaaaataaaaagcttaagaaatttaaaatgctagctgctcaagagttttcagtagaatatttaagaactaattttctgcagcttttagtttggaaaaaatattttaaaaacaaaatttgtgaaacctatagacgatgttttaatgtaccttcagctctctaaactgtgtgcttctactagtgtgtgctcttttcactgtagacactatcacgagacccagattaatttctgtggttgttacagaataagtctaatcaaggagaagtttctgtttgacgtttgagtgccggctttctgagtagagttaggaaaaccacgtaacgtagcatatgatgtataatagagtatacccgttacttaaaaagaagtctgaaatgttcgttttgtggaaaagaaactagttaaatttactattcctaacccgaatgaaattagcctttgccttattctgtgcatgggtaagtaacttatttctgcactgttttgttgaactttgtggaaacattctttcgagtttgtttttgtcattttcgtaacagtcgtcgaactaggcctcaaaaacatacgtaacgaaaaggcctagcgaggcaaattctgattgatttgaatctatatttttctttaaaaagtcaagggttctatattgtgagtaaattaaatttacatttgagttgtttgttgctaagaggtagtaaatgtaagagagtactggttccttcagtagtgagtatttctcatagtgcagctttatttatctccaggatgtttttgtggctgtatttgattgatatgtgcttcttctgattcttgctaatttccaaccatattgaataaatgtgatcaagtcaagga

SEQ ID NO: 126141 - DNA, 3174 bp, Homo sapiens
  Payload ID: 4738
  Gene Symbol: DLL1
  Gene Name: delta-like 1 (Drosophila)
  Uniprot ID: O00548
  ENST ID: ENST00000366756
  CDS Start-End: 335-2506
aaaccaggaagccggcgaccctcacctcctcgggggctgggaggaaggaggaaaacgaaagtcgccgccgccgcgctgtcccccgagagctgcctttcctcgggcatccctggggctgccgcgggacctcgcagggcggatataaagaaccgcggccttgggaagaggcggagaccggcttttaaagaaagaagtcctgggtcctgcggtctggggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgcgcctgccggaccttcttccgcgtgtgcctcaagcactaccaggccagcgtgtcccccgagccgccctgcacctacggcagcgccgtcacccccgtgctgggcgtcgactccttcagtctgcccgacggcgggggcgccgactccgcgttcagcaaccccatccgcttccccttcggcttcacctggccgggcaccttctctctgattattgaagctctccacacagattctcctgatgacctcgcaacagaaaacccagaaagactcatcagccgcctggccacccagaggcacctgacggtgggcgaggagtggtcccaggacctgcacagcagcggccgcacggacctcaagtactcctaccgcttcgtgtgtgacgaacactactacggagagggctgctccgttttctgccgtccccgggacgatgccttcggccacttcacctgtggggagcgtggggagaaagtgtgcaaccctggctggaaagggccctactgcacagagccgatctgcctgcctggatgtgatgagcagcatggattttgtgacaaaccaggggaatgcaagtgcagagtgggctggcagggccggtactgtgacgagtgtatccgctatccaggctgtctccatggcacctgccagcagccctggcagtgcaactgccaggaaggctgggggggccttttctgcaaccaggacctgaactactgcacacaccataagccctgcaagaatggagccacctgcaccaacacgggccaggggagctacacttgctcttgccggcctgggtacacaggtgccacctgcgagctggggattgacgagtgtgaccccagcccttgtaagaacggagggagctgcacggatctcgagaacagctactcctgtacctgcccacccggcttctacggcaaaatctgtgaattgagtgccatgacctgtgcggacggcccttgctttaacgggggtcggtgctcagacagccccgatggagggtacagctgccgctgccccgtgggctactccggcttcaactgtgagaagaaaattgactactgcagctcttcaccctgttctaatggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacagcgccgacaagaatggcttcaaggcccgctacccagcggtggactataacctcgtgcaggacctcaagggtgacgacaccgccgtcagggacgcgcacagcaagcgtgacaccaagtgccagccccagggctcctcaggggaggagaaggggaccccgaccacactcaggggtggagaagcatctgaaagaaaaaggccggactcgggctgttcaacttcaaaagacaccaagtaccagtcggtgtacgtcatatccgaggagaaggatgagtgcgtcatagcaactgaggtgtaaaatggaagtgagatggcaagactcccgtttctcttaaaataagtaaaattccaaggatatatgccccaacgaatgctgctgaagaggagggaggcctcgtggactgctgctgagaaaccgagttcagaccgagcaggttctcctcctgaggtcctcgacgcctgccgacagcctgtcgcggcccggccgcctgcggcactgccttccgtgacgtcgccgttgcactatggacagttgctcttaagagaatatatatttaaatgggtgaactgaattacgcataagaagcatgcactgcctgagtgtatattttggattcttatgagccagtcttttcttgaattagaaacacaaacactgcctttattgtcctttttgatacgaagatgtgctttttctagatggaaaagatgtgtgttattttttggatttgtaaaaatatttttcatgatatctgtaaagcttgagtattttgtgatgttcgttttttataatttaaattttggtaaatatgtacaaaggcacttcgggtctatgtgactatatttttttgtatataaatgtatttatggaatattgtgcaaatgttatttgagttttttactgttttgttaatgaagaaattcctttttaaaatatttttccaaaataaattttatgaatgacaa

SEQ ID NO: 126142 - DNA, 3174 bp, Homo sapiens; identical to SEQ ID NO: 126141
  Payload ID: 4738
  Gene Symbol: DLL1
  Gene Name: delta-like 1 (Drosophila)
  Uniprot ID: O00548
  ENST ID: ENST00000616526
  CDS Start-End: 335-2506

SEQ ID NO: 126143 - DNA, 548 bp, Homo sapiens
  Payload ID: 4738
  Gene Symbol: DLL1
  Gene Name: delta-like 1 (Drosophila)
  ENST ID: ENST00000630500
  CDS Start-End: 387-548
aactgctctggtgctggcggacctcgggtcgcgcagtcagaagctcaagacaaaaccaggaagccggcgaccctcacctcctcgggggctgggaggaaggaggaaaacgaaagtcgccgccgccgcgctgtcccccgagagctgcctttcctcgggcatccctggggctgccgcgggacctcgcagggcggatataaagaaccgcggccttgggaagaggcggagaccggcttttaaagaaagaagtcctgggtcctgcggtctggggcgaggcaagggcgcttttctgcccacgctccccgtggcccatcgatcccccgcgcgtccgccgctgttctaaggagagaagtgggggccccccaggctcgcgcgtggagcgaagcagcatgggcagtcggtgcgcgctggccctggcggtgctctcggccttgctgtgtcaggtctggagctctggggtgttcgaactgaagctgcaggagttcgtcaacaagaaggggctgctggggaaccgcaactgctgccgcgggggcgcggggccaccgccgtgc

SEQ ID NO: 126144 - DNA, 548 bp, Homo sapiens; identical to SEQ ID NO: 126143
  Payload ID: 4738
  Gene Symbol: DLL1
  Gene Name: delta-like 1 (Drosophila)
  ENST ID: ENST00000630365
  CDS Start-End: 387-548

SEQ ID NO: 126145 - DNA, 1324 bp, Homo sapiens
  Payload ID: 4739
  Gene Symbol: DLK1
  Gene Name: delta-like 1 homolog (Drosophila)
  Uniprot ID: P80370
  ENST ID: ENST00000331224
  CDS Start-End: 161-1093
ggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgag

SEQ ID NO: 126146 - DNA, 4722 bp, Homo sapiens
  Payload ID: 4739
  Gene Symbol: DLK1
  Gene Name: delta-like 1 homolog (Drosophila)
  Uniprot ID: P80370
  ENST ID: ENST00000341267
  CDS Start-End: 243-1394
ggggcggggggcgggggccgcgaggggggaggcggtacgaaaagggcggcgcgcgcggcggcggcggcagctccccggcagcggcggtggagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaatgagtaagagaaataagtatgttattctaaaatctaaactcaaatgaaatttcaaaaaagaccaaaaaaaaacaaggcaacagaaccagggctcagtgccgacgcccctaccctgggggtctcggccacatggtcctcgtgaaaccgttacgagtgctgtacatgaccacccactgtgcaaagagctacgattgctttcgttcgttaattctcacacaccacatccgactcgcactcacatccagctcaacatcgctacctttagatctttccgattgatttgagatttagcggagtgcagcggctgtgtgtcagtcagagagagccccaggttggctgctggggggccgggcctctgtgccagccctgccactaactcgctgtgtgatccttggcgagtccctatcccaatcctgggcccactttctcgcccctctcgagggaggggtttgaacaccgaccaccatggtcctctctggctctaaaactctgaattaggaacgagggggtatgaaccaaaacacttcctgaccccaacaattgggatctgatgaagacgaattctcatcctgggatccgaaaggttttggcctatcctggatgaacgcttgatgttgaaatttatcctaactgtgtttctcaaagtggggagcctcctggcccacttcccttttgggaaaaaatagcccctttgagtcataatgtgccatctggagttgccacttaggcagccagccctcccccacccctctttgcccacccagaaccccaacactatacctgcctctaccctatagagacatcccttgagacttgaatgtactttgagccgcaagtgcccctggcagaatctgagcagcaacacagccctcaccaaggttttcacagggattagtggaaattgtcacttgtggggcgcttactagttttgtggcaaatgtggtccaagacctggcccacacagccatgggtttacatttgtgttgctgagttaataatcctcagatctcaaaagacctagccagcttctgaattttgaatttgactttttttttttttttaacaaagagcatctatcttttttgcaaaaatagaaagaaatgggacagagctctgtttagcttttcagcttttggggttggacagctaaacagcccttgggtaccagataggaatattttgcttcttagattatttggataagaatctatactcttagctttattgagcattgcctgccgtgtttaccttgctccaggtgtttatttctaagtcatcatcaccttcgtcatctacagtcagtcacatcagtcacccacacacaactcacagtcacccatccattggtcacctgcgccatcgtcatgacacaatatcgacctcatcacctcatcgtcctccagccactacccaagccccctcatcctgactcaaagcccgaccagcatctgcccaaactcccaacaccccactctccccaccaagccattggtctcctcactcccggtcctttgtcatcctgattccaagccccgccccaccctcaccgcctcctccgcatcatctgcactctgcagagcccctcctacccgcctctgtccccaccaggcccctccctaccgtcagccctgagtcccacagcacgcgtccccagcccctcccagcctcaccccaaaaaccctgtcaccccaccgaccaccatcatcactggcaagccccttccccttctccagctcccgtccccactacccctcccgtcccccaatccttcccctcctgttagcccacccctcctttcctatcacccccacctttcccttcccattctccccacccttcccctccgatcccaccacccttcccttccgatccccgtcatccttcccctctgatcccccacccttcccctcctgtcctccccagccctcccttcctatcaccctcacccttcccctcccgttctccccacccttcccctcctgtctccaccagccctcccttcctatcacccccacccttctcctcccttccctcaccccaaacccctgggtcctccaccccaatctctgacaaccgccccaagtccctcttccttccccacgaagtcattcataagtcaccatctcatctcattttgagtttgttttaagaaataaaaaaattaaaaagacaaaaaaaagaattgttggcatgtgtcaggcgggcgtctggtaccctgcctggcctctctcagcgtgagacctggactgagcctgctaacgattctgttcctcagtttccccaaatagaaaattctaagattggtcagatgatcaaattatctatgttttcgatcttgatgctatagagaacagccatgttcccctgataacaagaaaaagacgtcccacggtcgaggtatccttgaccaactccccatccattcatttgttcaccgtccacaacccatctgatcaggaagcatttccaggcacctgcggagcactaggcagtgtgcggaagctgcagggcaggcaggacgagggggcagtctggaggggggtggacacacagctgtccccagggagcccagcgcggtgccggtcacatgccgtgggagtggagggtcttgagcagacgcctcccttggagaagagccaccatctcaccttcccacgcaacaaattatctattaccagcacccgatgaggccgtccctcccaaattccacagtgcccaccactcgcactaccccccccgtgccacagaagcagtgtcagcagcctcgccacggtcttcacgtcatgcagaaatggtcattccatgttctatggccaccagattctgctgagagtgtcgggatccttgactgcccagccacaccttgtgtgtgtctggtgtagtgtgtagtttacgaaacaaacggaaaagctcaaagacagcgatccaagacatgatcagcaatttggtcccaaattaggagaggaggaagaggagtatcaattttgtcaccaaaatgttaaaaaaaatgtccttggcgctctttttagctttcccgtttactaccagtccagacatgcaaaaaaaccttgtttattgaaaaataaacaacaagggctaga

SEQ ID NO: 126147 - DNA, 555 bp, Homo sapiens
  Payload ID: 4739
  Gene Symbol: DLK1
  Gene Name: delta-like 1 homolog (Drosophila)
  ENST ID: ENST00000392848
  CDS Start-End: 265-555
aatggggaggaggggtgtctgaggagcactccctctccctgggagctctgcagaggaagagggtctctggcaatcagcatcctctacctccacctctccagcgggcgacccctcagagaaggtctcccacgataagtgtttcggtgttcctgcgtgcggatttgtgctctccggggaggtctgcggcccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgt

SEQ ID NO: 126148 - DNA, 469 bp, Homo sapiens
  Payload ID: 4739
  Gene Symbol: DLK1
  Gene Name: delta-like 1 homolog (Drosophila)
  ENST ID: ENST00000556051
  CDS Start-End: 40-450
ccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagaggttggcactcgcctttgttcacctcagctctgcgtccttacctgcctgccctagcccctaccacctcctcccagtctcctgttgctggtgttcctcacttcctcattcctgcacactccgtgccctgtattctaaagatctgtttataaatttcctgtgggtaccgaa

SEQ ID NO: 126149 - DNA, 2038 bp, Homo sapiens
  Payload ID: 4740
  Gene Symbol: DLK2
  Gene Name: delta-like 2 homolog (Drosophila)
  Uniprot ID: Q6UY11
  ENST ID: ENST00000357338
  CDS Start-End: 702-1853
agcgattttcctgcctcagccttccgagtagctgggattacaggcgcgcaccaccacgcctggctaatttctgtatttttaatagagacgggtttcaccatgttggccaggctggtctcgaactcctgacctcaggtgatccgcccgcctcagcctcccaaagtgctggaattataggcgtgagcccaccgagcttggctgggtccttgtcttgaaatgtgtctctgagccattagccagaagggggcaaagaggcctggagggcagctttcccccactccccctccgttactctctgaatctgagctccaggtttgggcagttgaggtttagcctgaggccaaggacgaacgtgatggggtacaggagaagacttggcggtggagggggttttgtgtgcacatttacagagtcaggggcattcccagtccagaaaggattctcagaggcagtcacaaaaaggaatggggtggaagggctgagacttgagggagggaagggtggtgggggtagggccggggtgtggttgggtggatcgggttgatatttatatagggataggttgatcttggaaggctggagacggcaacgtggacaggaagaagcggagggcgaggaggagcagaggagcacacagatgaagcaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgc

SEQ ID NO: 126150 - DNA, 1572 bp, Homo sapiens
  Payload ID: 4740
  Gene Symbol: DLK2
  Gene Name: delta-like 2 homolog (Drosophila)
  ENST ID: ENST00000372485
  CDS Start-End: 252-1385
gaggagcagccgctgccgccgctcggggtcgcctggagccccagattcccgagcgctcggctcgcatggcagccgcttcggcgcccggccccgcggccagctaggggcggccccgcgctccctcacggcccctcggcggcgcccgtcggatccggcctctctctgcgccccggggcgcgccacctccccgccggaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa

SEQ ID NO: 126151 - DNA, 1590 bp, Homo sapiens
  Payload ID: 4740
  Gene Symbol: DLK2
  Gene Name: delta-like 2 homolog (Drosophila)
  Uniprot ID: Q6UY11
  ENST ID: ENST00000372488
  CDS Start-End: 252-1403
gaggagcagccgctgccgccgctcggggtcgcctggagccccagattcccgagcgctcggctcgcatggcagccgcttcggcgcccggccccgcggccagctaggggcggccccgcgctccctcacggcccctcggcggcgcccgtcggatccggcctctctctgcgccccggggcgcgccacctccccgccggaggtgtccacgcgtccggccgtccatccgtccgtccctcctggggccggcgctgaccatgcccagcggctgccgctgcctgcatctcgtgtgcctgttgtgcattctgggggctcccggtcagcctgtccgagccgatgactgcagctcccactgtgacctggcccacggctgctgtgcacctgacggctcctgcaggtgtgacccgggctgggaggggctgcactgtgagcgctgtgtgaggatgcctggctgccagcacggtacctgccaccagccatggcagtgcatctgccacagtggctgggcaggcaagttctgtgacaaagatgaacatatctgtaccacgcagtccccctgccagaatggaggccagtgcatgtatgacgggggcggtgagtaccattgtgtgtgcttaccaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa

SEQ ID NO: 126152 - DNA, 1056 bp, Homo sapiens
  Payload ID: 4740
  Gene Symbol: DLK2
  Gene Name: delta-like 2 homolog (Drosophila)
  ENST ID: ENST00000430324
  CDS Start-End: 1-869
ctggctgccagcacggtacctgccaccagccatggcagtgcatctgccacagtggctgggcaggcaagttctgtgacaaaggcttccatgggcgtgactgcgagcgcaaggctggaccctgtgaacaggcaggctccccatgccgcaatggcgggcagtgccaggacgaccagggctttgctctcaacttcacgtgccgctgcttggtgggctttgtgggtgcccgctgtgaggtaaatgtggatgactgcctgatgcggccttgtgctaacggtgccacctgccttgacggcataaaccgcttctcctgcctctgtcctgagggctttgctggacgcttctgcaccatcaacctggatgactgtgccagccgcccatgccagagaggggcccgctgtcgggaccgtgtccacgacttcgactgcctctgccccagtggctatggtggcaagacctgtgagcttgtcttacctgtcccagaccccccaaccacagtggacacccctctagggcccacctcagctgtagtggtacctgccacggggccagccccccacagcgcaggggctggtctgctgcggatctcagtgaaggaggtggtgcggaggcaagaggctgggctaggtgagcctagcttggtggccctggtggtgtttggggccctcactgctgccctggttctggctactgtgttgctgaccctgagggcctggcgccggggtgtctgcccccctggaccctgttgctaccctgccccacactatgctccagcgtgccaggaccaggagtgtcaggttagcatgctgccagcagggctccccctgccacgtgacttgccccctgagcctggaaagaccacagcactgtgatggaggtgggggctttctggcccccttcctcacctcttccacccctcagactggagtggtccgttctcaccacccttcagcttgggtacacacacagaggagacctcagcctcacaccagaaatattatttttttaatacacagaatgtaagatggaattttatcaaataaaactatgaaaatgcaa

SEQ ID NO: 126153 - DNA, 2332 bp, Homo sapiens
  Payload ID: 4741
  Gene Symbol: DLL3
  Gene Name: delta-like 3 (Drosophila)
  Uniprot ID: Q9NYJ7
  ENST ID: ENST00000205143
  CDS Start-End: 8-1864
gaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgctggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacccggtttccaaggctccaactgtgagaagagggtggaccggtgcagcctgcagccatgccgcaatggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggtagcgacgccccttttccccccgctacacactgggcgcgctgggcagaggcagcacctgctttttccctacccttcctcgattctgtccgtgaaatgaattgggtagagtctctggaaggttttaagcccattttcagttctaacttactttcatcctattttgcatccctcttatcgttttgagctacctgccatcttctctttgaaaaacctatgggcttgaggaggtcacgatgccgactccgccagagcttttccactgattgtactcagcggggaggcaggggaggcagaggggcagcctctctaatgcttcctactcattttgtttctaggcctgacgcgtctcctccatccgcacctggagtcagagcgtggatttttgtatttgctcggtggtgcccagtctctgccccagaggctttggagttcaatcttgaaggggtgtctgggggaactttactgttgcaagttgtaaataatggttatttatatcctattttttctcaccccatctctctagaaacacctataaaggctattattgtgatcagttttgactaac

SEQ ID NO: 126154 - DNA, 2055 bp, Homo sapiens
  Payload ID: 4741
  Gene Symbol: DLL3
  Gene Name: delta-like 3 (Drosophila)
  Uniprot ID: Q9NYJ7
  ENST ID: ENST00000356433
  CDS Start-End: 81-1844
gaaggggcggggccattctctcagatataaggcttggaagccagcagctgcgactcccgagacccccccaccagaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgctggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacccggtttccaaggctccaactgtgagaagagggtggaccggtgcagcctgcagccatgccgcaatggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggcctgacgcgtctcctccatccgcacctggagtcagagcgtggatttttgtatttgctcggtggtgcccagtctctgccccagaggctttggagttcaatcttgaaggggtgtctgggggaactttactgttgcaagttgtaaataatggttatttatatcctattttttctcaccccatctctctagaaacacctataaaggctattattgtgatc

SEQ ID NO: 126155 - DNA, 668 bp, Homo sapiens
  Payload ID: 4741
  Gene Symbol: DLL3
  Gene Name: delta-like 3 (Drosophila)
  ENST ID: ENST00000596614
  CDS Start-End: 9-668
agaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacggcctcttgcaggtgcccttccgggacgcctggcctggcaccttctctttcatcatcgaaacctggagagaggagttaggagaccagattggaggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttc

SEQ ID NO: 126156 - DNA, 3372 bp, Homo sapiens
  Payload ID: 4742
  Gene Symbol: DLL4
  Gene Name: delta-like 4 (Drosophila)
  Uniprot ID: Q9NR61
  ENST ID: ENST00000249749
  CDS Start-End: 277-2334
gccgccttggtgcagcgtacaccggcactagcccgcttgcagccccaggattagacagaagacgcgtcctcggcgcggtcgccgcccagccgtagtcacctggattacctacagcggcagctgcagcggagccagcgagaaggccaaaggggagcagcgtcccgagaggagcgcctcttttcagggaccccgccggctggcggacgcgcgggaaagcggcgtcgcgaacagagccagattgagggcccgcgggtggagagagcgacgcccgaggggatggcggcagcgtcccggagcgcctctggctgggcgctactgctgctggtggcactttggcagcagcgcgcggccggctccggcgtcttccagctgcagctgcaggagttcatcaacgagcgcggcgtactggccagtgggcggccttgcgagcccggctgccggactttcttccgcgtctgccttaagcacttccaggcggtcgtctcgcccggaccctgcaccttcgggaccgtctccacgccggtattgggcaccaactccttcgctgtccgggacgacagtagcggcggggggcgcaaccctctccaactgcccttcaatttcacctggccgggtaccttctcgctcatcatcgaagcttggcacgcgccaggagacgacctgcggccagaggccttgccaccagatgcactcatcagcaagatcgccatccagggctccctagctgtgggtcagaactggttattggatgagcaaaccagcaccctcacaaggctgcgctactcttaccgggtcatctgcagtgacaactactatggagacaactgctcccgcctgtgcaagaagcgcaatgaccacttcggccactatgtgtgccagccagatggcaacttgtcctgcctgcccggttggactggggaatattgccaacagcctatctgtctttcgggctgtcatgaacagaatggctactgcagcaagccagcagagtgcctctgccgcccaggctggcagggccggctgtgtaacgaatgcatcccccacaatggctgtcgccacggcacctgcagcactccctggcaatgtacttgtgatgagggctggggaggcctgttttgtgaccaagatctcaactactgcacccaccactccccatgcaagaatggggcaacgtgctccaacagtgggcagcgaagctacacctgcacctgtcgcccaggctacactggtgtggactgtgagctggagctcagcgagtgtgacagcaacccctgtcgcaatggaggcagctgtaaggaccaggaggatggctaccactgcctgtgtcctccgggctactatggcctgcattgtgaacacagcaccttgagctgcgccgactccccctgcttcaatgggggctcctgccgggagcgcaaccagggggccaactatgcttgtgaatgtccccccaacttcaccggctccaactgcgagaagaaagtggacaggtgcaccagcaacccctgtgccaacgggggacagtgcctgaaccgaggtccaagccgcatgtgccgctgccgtcctggattcacgggcacctactgtgaactccacgtcagcgactgtgcccgtaacccttgcgcccacggtggcacttgccatgacctggagaatgggctcatgtgcacctgccctgccggcttctctggccgacgctgtgaggtgcggacatccatcgatgcctgtgcctcgagtccctgcttcaacagggccacctgctacaccgacctctccacagacacctttgtgtgcaactgcccttatggctttgtgggcagccgctgcgagttccccgtgggcttgccgcccagcttcccctgggtggccgtctcgctgggtgtggggctggcagtgctgctggtactgctgggcatggtggcagtggctgtgcggcagctgcggcttcgacggccggacgacggcagcagggaagccatgaacaacttgtcggacttccagaaggacaacctgattcctgccgcccagcttaaaaacacaaaccagaagaaggagctggaagtggactgtggcctggacaagtccaactgtggcaaacagcaaaaccacacattggactataatctggccccagggcccctggggcgggggaccatgccaggaaagtttccccacagtgacaagagcttaggagagaaggcgccactgcggttacacagtgaaaagccagagtgtcggatatcagcgatatgctcccccagggactccatgtaccagtctgtgtgtttgatatcagaggagaggaatgaatgtgtcattgccacggaggtataaggcaggagcctacctggacatccctgctcagccccgcggctggaccttccttctgcattgtttacattgcatcctggatgggacgtttttcatatgcaacgtgctgctctcaggaggaggagggaatggcaggaaccggacagactgtgaacttgccaagagatgcaatacccttccacacctttgggtgtctgtctggcatcagattggcagctgcaccaaccagaggaacagaagagaagagagatgccactgggcactgccctgccagtagtggccttcagggggctccttccggggctccggcctgttttccagagagagtggcagtagccccatggggcccggagctgctgtggcctccactggcatccgtgtttccaaaagtgcctttggcccaggctccacggcgacagttgggcccaaatcagaaaggagagagggggccaatgagggcagggcctcctgtgggctggaaaaccactgggtgcgtctcttgctggggtttgccctggaggtgaggtgagtgctcgagggaggggagtgctttctgccccatgcctccaactactgtatgcaggcctggctctctggtctaggccctttgggcaagaatgtccgtctacccggcttccaccaccctctggccctgggcttctgtaagcagacaggcagagggcctgcccctcccaccagccaagggtgccaggcctaactggggcactcagggcagtgtgttggaaattccactgagggggaaatcaggtgctgcggccgcctgggccctttcctccctcaagcccatctccacaacctcgagcctgggctctggtccactactgccccagaccaccctcaaagctggtcttcagaaatcaataatatgagtttttattttgtttttttttttttttttgtagtttattttggagtctagtatttcaataatttaagaatcagaagcactgacctttctacattttataacattattttgtatataatgtgtatttataatatgaaacagatgtgtacagg

SEQ ID NO: 126157 - DNA, 3455 bp, Homo sapiens
  Payload ID: 4743
  Gene Symbol: DTX1
  Gene Name: deltex 1, E3 ubiquitin ligase
  Uniprot ID: Q86Y01
  ENST ID: ENST00000257600
  CDS Start-End: 504-2366
gcgagaagccccactgaagccgggcgcagggtctgggacgcagttgggagtgcaaagggctggctgagagccgcaggagcagcaggctgtggcccaggcctcctgggtgacaggccctgtctggcggggaagagggaccaagagacaacacggaagaggctggacctcgaacaggggcggctgcctcactccctacctgagccagccgagggggccaaggactttagagctgtttcctccggcataagagagacacttgctttccagggcagcaccctttatcggagaaggctctacagggaaggggtctttgcagcctggatggccatcccacattcctttaacggaggtctctaggcctcagagagaacccagagttagaaaggaggccagacggtccttgctgtccccctggggagagaggaagttgccgcctgctgccaggcccaggaggagctgggcctgcaatagtgggggacctggcccctgaggcagtggcggccatgtcacggccaggccacggtgggctgatgcctgtgaatggtctgggcttcccaccgcagaacgtggcccgggtggtggtgtgggagtggctgaatgagcacagccgctggcggccctacacggccaccgtgtgccaccacattgagaacgtgctgaaggaggacgctcgcggttccgtggtcctggggcaggtggacgcccagcttgtgccctacatcatcgacctgcagtccatgcaccagtttcgccaggacacaggcaccatgcggcccgtgcggcgcaacttctacgacccgtcgtcggcgccgggcaagggcatcgtgtgggagtgggagaacgacggcggcgcatggacggcctacgatatggacatctgcatcaccatccagaacgcctacgagaagcagcacccgtggctcgacctctcatcgctaggcttctgctacctcatctacttcaacagcatgtcgcagatgaaccgccagacgcgccggcgccgccgcctgcgccgccgcctggacctcgcctacccgctcaccgtgggctccatccctaagtcgcagtcgtggcccgtgggcgccagctcgggccagccctgctcctgccagcagtgcctgctggtcaacagcacgcgcgccgcctccaacgccatcctggcctcgcagcgccgcaaggcgccccccgcgcccccgctgccgccgccgccgccacctggagggcctccaggcgcgcttgccgtgcgccccagcgccaccttcacaggcgccgcgctctgggcagcgcccgccgccggccccgccgagcccgcgccgcctcccggggcgcccccacggagcccgggcgcccccggcggagcgcgcaccccggggcagaacaacctcaaccggcccgggccccagcgcaccaccagcgtgagcgcgcgcgcctccatcccgccgggggtccccgcactcccggtgaagaacttgaatggtactgggccggtccatccggccctggcagggatgaccgggatactgctgtgcgcggccgggctgcccgtgtgcctgacgcgggcccccaagcccatcctgcacccgccgcccgtgagcaagagcgacgtgaagcccgtgcctggcgtgcccggggtgtgccgcaagaccaagaagaagcaccttaaaaagagtaagaatcccgaggatgtggttcgaagatacatgcagaaggtgaaaaacccacctgatgaggactgcaccatctgcatggagcgactggtcacagcatcaggctacgagggcgtgcttcggcacaagggcgtgcggcctgagctcgtgggccgcctgggccgctgtggccacatgtaccacctgctgtgcctcgtggccatgtactccaatggcaacaaggatggcagcctgcagtgccccacctgcaaggccatctacggggagaagacgggtacgcagccgcctgggaagatggagttccacctcatcccccactcgctgcccggcttccctgatacccagaccatccgcatcgtctatgacatccccacaggcatccagggccctgagcaccccaaccccgggaagaagttcaccgcaagaggattccctcgccactgctatctacccaacaacgagaaaggccggaaggtgctgcggctgctcatcacggcctgggagagaagactcatcttcactatcggcacgtccaacaccacgggcgagtcggacaccgtggtgtggaacgagatccaccacaagaccgagtttggatccaacctcacgggccacggctacccggacgctagctacctagacaacgtgctggctgagctcacagcccagggcgtatccgaggctgcagccaaggcttgaggcccaaggctgcccaccttccctcctgctttgcccctggtccggcaaatgcctccttcgccaggtgtgtcctggtagcccaggttcagggctggggaggagcctgcggaaggggccgcagccattcaggggacctgcctggtggcagctgggatgaagagagatggcatgtcaggctggccccgaatcatagctccctgagagggccaagcagagagtactggaaacctccctaccaaaaagacagagacccgccccctcacacacaaacacacatgtcctgttgaactcatgcacgcacacccacgtgcctgtacttgcccccaggctggaagagaagagacagaaagaccccatgacccccccatgtggatccccatctgtgtctcagttgcatctgtacagccttgtctgcaaactggaggatgcggggcaagcccttaggggcctgccagggctcggggggcaaagagggactcgggaaactcagtgtaccccagatgcctcacccattccgtgtcatcacccatgtctgccacccactgattgggcaattgtgggcccatggggtggaagcccccagatgactgagcagttctacaaaagaatggccagcacgagcggggactagagggtcctgattttgtgtctgtgcctcttcatctctctggactctgatctccttctcccttcccatctccaggccttctgtctgtcccagataaaggcgctgttctcccatcctccctaccccatcctctccaccaaatcgctcccaattttgagagccaaaggctggcgcttctgacttcaggagcgaaaggaggaggcctagtttgggccgatgtattttaaagcagagtggacagcagagagtcaatttccctttcgttgggagtgggcagtggggtggctaattgtcttcggccaaccaggggcctgttgcccaggcaactcaccagctccgcctctgctgattggctgccacggtgggagtcagccaagatttaaagggatgccagcgattgctcttttcaaaacctaccagtcccactgtgggtggagaaataaatggtctttctcctcctc

SEQ ID NO: 126158 - DNA, 2769 bp, Homo sapiens
  Payload ID: 4744
  Gene Symbol: DTX2
  Gene Name: deltex 2, E3 ubiquitin ligase
  Uniprot ID: Q86UW9
  ENST ID: ENST00000324432
  CDS Start-End: 511-2379
gcgacgccgagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggatctggtactgttctggagtggcctgtagcagacactgaaccaccagccagctgcatttgttgtcctggaagtcattgccaactctgccagtcacactggggtccccagagaagtcaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaa

SEQ ID NO: 126159 - DNA, 540 bp, Homo sapiens
  Payload ID: 4744
  Gene Symbol: DTX2
  Gene Name: deltex 2, E3 ubiquitin ligase
  ENST ID: ENST00000438930
  CDS Start-End: 272-540
tggctgccttctcctgagagtcggagccacagccagagccctgcccaggccgagccggagctgcagcccgagcgcggtggtgccctcagccccgtcctcttgtcctcctcagcctcgaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccgg

SEQ ID NO: 126160 - DNA, 550 bp, Homo sapiens
  Payload ID: 4744
  Gene Symbol: DTX2
  Gene Name: deltex 2, E3 ubiquitin ligase
  ENST ID: ENST00000451769
  CDS Start-End: 466-550
agctgcgacgccgagtttcactctggctgccttctcctgagagtcggagccacagccagagccctgcccaggccgagccggagctgcagcccgagcgcggtggtgccctcagccccgtcctcttgtcctcctcagcctcggctgtttttgcagagttgtgagagttggttcatccgggccatgaggacatgttgggacataccccgtgtgccgatgatggaggcggccgtggctgcccgagagatgcgtgacacccaggagtaattggcttggaaggcagtcctctgatttgtacctcattgtggttacagaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgg

SEQ ID NO: 126161 - DNA, 2472 bp, Homo sapiens
  Payload ID: 4744
  Gene Symbol: DTX2
  Gene Name: deltex 2, E3 ubiquitin ligase
  Uniprot ID: Q86UW9
  ENST ID: ENST00000413936
  CDS Start-End: 211-2079
actctggctgccttctcctgagagtcggagccacagccagagccctgcccaggccgagccggagctgcagcccgagcgcggtggtgccctcagccccgtcctcttgtcctcctcagcctcgatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcc

SEQ ID NO: 126162 - DNA, 633 bp, Homo sapiens
  Payload ID: 4744
  Gene Symbol: DTX2
  Gene Name: deltex 2, E3 ubiquitin ligase
  ENST ID: ENST00000457529
  CDS Start-End: 448-633
gagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagc

SEQ ID NO: 126163 - DNA, 570 bp, Homo sapiens
  Payload ID: 4744
  Gene Symbol: DTX2
  Gene Name: deltex 2, E3 ubiquitin ligase
  ENST ID: ENST00000442516
  CDS Start-End: 529-570
ctgtctcagccagctgccctcctcctccaagctggctccacttctctaagcgccaacagcgatggaaataaatagcatgtgtacagacgcctggacccttgagaaactcagaatatttctgcatgccttcctagctcctctagcgctctagaaggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggatctggtactgttctggagtggcctgtagcagacactgaaccaccagccagctgcatttgttgtcctggaagtcattgccaactctgccagtcacactggggtccccagagaagtcaagatctgccggaggcgctgggcaatgaccccgggactccaggccagaggggtctgaagctgtttgggaaagcagcgggactccttgggaagatggccatggccccaagcccttccctggtgcaggtgtacacc

SEQ ID NO: 126164 - DNA, 1770 bp, Homo sapiens
  Payload ID: 4744
  Gene Symbol: DTX2
  Gene Name: deltex 2, E3 ubiquitin ligase
  Uniprot ID: Q86UW9
  ENST ID: ENST00000446820
  CDS Start-End: 1-1728
atggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctg

SEQ ID NO: 126165 - DNA, 2281 bp, Homo sapiens
  Payload ID: 4744
  Gene Symbol: DTX2
  Gene Name: deltex 2, E3 ubiquitin ligase
  ENST ID: ENST00000446600
  CDS Start-End: 299-1894
gagtttcactctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaaggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagcc

SEQ ID NO: 126166 - DNA, 434 bp, Homo sapiens
  Payload ID: 4744
  Gene Symbol: DTX2
  Gene Name: deltex 2, E3 ubiquitin ligase
  ENST ID: ENST00000435861
  CDS Start-End: 166-434
tgatacaatctggtgattcccgagcatacacatcatattttatccccattttgccaatgaggaaactgagacccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccgg

SEQ ID NO: 126167 - DNA, 539 bp, Homo sapiens
  Payload ID: 4744
  Gene Symbol: DTX2
  Gene Name: deltex 2, E3 ubiquitin ligase
  ENST ID: ENST00000429179
  CDS Start-End: 216-539
cttttcaagcaaagccccatctcgccgtgctcacaggactactgtcataggaacatggatgaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccga

SEQ ID NO: 126168 - DNA, 566 bp, Homo sapiens
  Payload ID: 4744
  Gene Symbol: DTX2
  Gene Name: deltex 2, E3 ubiquitin ligase
  ENST ID: ENST00000425780
  CDS Start-End: 372-566
atgcgcagcggctcgctcggaagctgcgacgccgagtttcactctggctgccttctcctgagagtcggagccacagccagagccctgcccaggccgagccggagctgcagcccgagcgcggtggtgccctcagccccgtcctcttgtcctcctcagcctcggagctggtgtcttcatccagaagggacagtttgtgccagctctccagagagaaaagaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttg

SEQ ID NO: 126169 - DNA, 569 bp, Homo sapiens
  Payload ID: 4744
  Gene Symbol: DTX2
  Gene Name: deltex 2, E3 ubiquitin ligase
  ENST ID: ENST00000456590
  CDS Start-End: 495-569
agctgcgacgccgagtttcactctggctgccttctcctgagagtcggagccacagccagagccctgcccaggccgagccggagctgcagcccgagcgcggtggtgccctcagccccgtcctcttgtcctcctcagcctcgtccccaggcacagcacacggatccaacatctgtacctttgtttttactaactgctgtttcttaatttaaaacctgatcatcttcttcctcgttggcaaaggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcag

SEQ ID NO: 126170 - DNA, 547 bp, Homo sapiens
  Payload ID: 4744
  Gene Symbol: DTX2
  Gene Name: deltex 2, E3 ubiquitin ligase
  ENST ID: ENST00000435251
  CDS Start-End: 1-262
tgcctccctccccagcggtccctcaagcagcccagggagcgtccctgccactgtgcccatgcagatgccaaagcccagcagagtccagcaggcgctcgcaggagcgaccccgaagccagagccagagccagagcaggtcataaaaaactacacggaagagctgaaagtgcccccagatgagtctgttgagtccatgagaaaaatctggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataagcatccctgtgcagtcagcacagtgctcatgagggagaggctcagagcaggggctgtgcccagggtcaccccactgggaggtgggagccaggccttgaggcagggctgatcctgggccccacagcagcctacacatgaagagccgcgcccagactgacccccagctgctctccctgcatcgg

SEQ ID NO: 126171 - DNA, 2623 bp, Homo sapiens
  Payload ID: 4744
  Gene Symbol: DTX2
  Gene Name: deltex 2, E3 ubiquitin ligase
  Uniprot ID: Q86UW9
  ENST ID: ENST00000430490
  CDS Start-End: 365-2233
cttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttctgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagcgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaaggagcgaccccgaagccagagccagagccagagcaggtcataaaaaactacacggaagagctgaaagtgcccccagatgaggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaa

SEQ ID NO: 126172 - DNA, 859 bp, Homo sapiens
  Payload ID: 4744
  Gene Symbol: DTX2
  Gene Name: deltex 2, E3 ubiquitin ligase
  ENST ID: ENST00000423646
  CDS Start-End: 440-859
ctctggctgccttctcctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagaaacttccaattgaagacactgagctgaaccattccgcccgcccgcccgcccgagggcactccagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgggctgtgcggagacacctgttcccccagcactcagcccctggccgaggtgtcgtctgggagtggctgagcgacgatggctcctggactgcctatgaagccagcgtctgtgactatctggagcagcaggtggccaggggcaac

SEQ ID NO: 126173 - DNA, 681 bp, Homo sapiens
  Payload ID: 4744
  Gene Symbol: DTX2
  Gene Name: deltex 2, E3 ubiquitin ligase
  ENST ID: ENST00000631991
  CDS Start-End: 1-639
gactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctg

SEQ ID NO: 126174 - DNA, 1032 bp, Homo sapiens
  Payload ID: 4744
  Gene Symbol: DTX2
  Gene Name: deltex 2, E3 ubiquitin ligase
  ENST ID: ENST00000632696
  CDS Start-End: 1-639
gactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaagcc

SEQ ID NO: 126175 - DNA, 1026 bp, Homo sapiens
  Payload ID: 4744
  Gene Symbol: DTX2
  Gene Name: deltex 2, E3 ubiquitin ligase
  ENST ID: ENST00000631700
  CDS Start-End: 1-639
gactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagcc

SEQ ID NO: 126176 - DNA, 366 bp, Homo sapiens
  Payload ID: 4744
  Gene Symbol: DTX2
  Gene Name: deltex 2, E3 ubiquitin ligase
  ENST ID: ENST00000633541
  CDS Start-End: 1-81
tctgttgagtccatgagaaaaatctggactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataagcatccctgtgcagtcagcacagtgctcatgagggagaggctcagagcaggggctgtgcccagggtcaccccactgggaggtgggagccaggccttgaggcagggctgatcctgggccccacagcagcctacacatgaagagccgcgcccagactgacccccagctgctctccctgcatcgg

SEQ ID NO: 126177 - DNA, 1029 bp, Homo sapiens
  Payload ID: 4744
  Gene Symbol: DTX2
  Gene Name: deltex 2, E3 ubiquitin ligase
  ENST ID: ENST00000634040
  CDS Start-End: 1-639
gactgcatcatctgcatggagaagctgtccacagcgtctggatacagcgatgtgactgacagcaaggcaatcgggtccctagctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagccaaa

SEQ ID NO: 126178 - DNA, 1029 bp, Homo sapiens; identical to SEQ ID NO: 126177
  Payload ID: 4744
  Gene Symbol: DTX2
  Gene Name: deltex 2, E3 ubiquitin ligase
  ENST ID: ENST00000631645
  CDS Start-End: 1-639

SEQ ID NO: 126179 - DNA, 5868 bp, Homo sapiens
  Payload ID: 4745
  Gene Symbol: DTX3L
  Gene Name: deltex 3 like, E3 ubiquitin ligase
  Uniprot ID: Q8TDB6
  ENST ID: ENST00000296161
  CDS Start-End: 190-2412
tactcacccggcaggccgctctcctcggtgcagacagcacagggaggagggggaagcggctctgccgggaacagggagggacctccagggaagcgaaactgaaactttgcgcccagtccgcagggcgggccgcgcctttaccgcccagctgcctcccggagcccccgcgccctcccgacgcgcagagccatggcctcccacctgcgcccgccgtccccgctcctcgtgcgggtgtacaagtccggcccccgagtacgaaggaagctggagagctacttccagagctctaagtcctcgggcggcggggagtgcacggtcagcacccaggaacacgaagccccgggcaccttccgggtggagttcagtgaaagggcagctaaggagagagtgttgaaaaaaggagagcaccaaatacttgttgacgaaaaacctgtgcccattttcctggtacccactgaaaattcaataaagaagaacacgagacctcaaatttcttcactgacacaatcacaagcagaaacaccgtctggtgatatgcatcaacatgaaggacatattcctaatgctgtggattcctgtctccaaaagatctttcttactgtaacagctgacctgaactgtaacctgttctccaaagagcagagggcatacataaccacactgtgccctagtatcagaaaaatggaaggtcacgatggaattgagaaggtgtgtggtgacttccaagacattgaaagaatacatcaatttttgagtgagcagttcctggaaagtgagcagaaacaacaattttccccttcaatgacagagaggaagccactcagtcagcaggagagggacagctgcatttctccttctgaaccagaaaccaaggcagaacaaaaaagcaactattttgaagttcccttgccttactttgaatactttaaatatatctgtcctgataaaatcaactcaatagagaaaagatttggtgtaaacattgaaatccaggagagttctccaaatatggtctgtttagatttcacctcaagtcgatcaggtgacctggaagcagctcgtgagtcttttgctagtgaatttcagaagaacacagaacctctgaagcaagaatgtgtctctttagcagacagtaagcaggcaaataaattcaaacaggaattgaatcaccagtttacaaagctccttataaaggagaaaggaggcgaattaactctccttgggacccaagatgacatttcagctgccaaacaaaaaatctctgaagcttttgtcaagatacctgtgaaactatttgctgccaattacatgatgaatgtaattgaggttgatagtgcccactataaacttttagaaactgaattactacaggagatatcagagatcgaaaaaaggtatgacatttgcagcaaggtttctgagaaaggtcagaaaacctgcattctgtttgaatccaaggacaggcaggtagatctatctgtgcatgcttatgcaagtttcatcgatgcctttcaacatgcctcatgtcagttgatgagagaagttcttttactgaagtctttgggcaaggagagaaagcacttacatcagaccaagtttgctgatgactttagaaaaagacatccaaatgtacactttgtgctaaatcaagagtcaatgactttgactggtttgccaaatcaccttgcaaaggcgaagcagtatgttctaaaaggaggaggaatgtcttcattggctggaaagaaattgaaagagggtcatgaaacaccgatggacattgatagcgatgattccaaagcagcttctccgccactcaagggctctgtgagttctgaggcctcagaactggacaagaaggaaaagggcatctgtgtcatctgtatggacaccattagtaacaaaaaagtgctaccaaagtgcaagcatgaattctgcgccccttgtatcaacaaagccatgtcatataagccaatctgtcccacatgccagacttcctatggtattcagaaaggaaatcagccagagggaagcatggttttcactgtttcaagagactcacttccaggttatgagtcctttggcaccattgtgattacttattctatgaaagcaggcatacaaacagaagaacacccaaacccaggaaagagataccctggaatacagcgaactgcatacttgcctgataataaggaaggaaggaaggttttgaaactgctttatagggcctttgaccaaaagctgatttttacagtggggtactctcgcgtattaggagtctcagatgtcatcacttggaatgatattcaccacaaaacatcccggtttggaggaccagaaatgtatggctatcctgatccttcttacctgaaacgtgtcaaagaggagctgaaagccaaaggaattgagtaagacaactgctggaagatgtcttaaatcaagctttcaaaaaaatatattttaggaggctgatttaatgccagtctaaatccttatgtagaaaggactttgaaatttttcttctcaagaaatggtttgtataagaataacaatctgctagtctgtcatttctggagtgatacttttttttttgagacggagtctgctctgtcgctcgcgctggagtgcagtggcatgatctcggctcactgcaagctccgcctcccaggttcatgccattctcctacctcagcctcccgagtagctgggactacaggcgcccaccaccatgcccggctaatttttgtttttgtatttttagtagagacagggtttcactgtgttagccaggatggtctcgatctcctgacctcgtgatccgcccgcctcagccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcaggagtaaggaagccatttctggagtccttgctactaatttggaaaactgagcttctttctttcattgctttttcccttaagagacaagtccttactatattgccctgtctctcaagggaagacatcaagactggacttgaactcctgggctcaagccatcccccaaccttggcctctcgagtagatgggattataggcatgtgccacggtgcctgacttgagtttcttattctagaacacttggagcctgaactctgaccaggcccctcacttgagcctttgctttctgctccttgtaaactgccatattgggtgcacttgccctgccacagtaatgctatatatttctgagcattgtttttctctagataattttatatttttgagtataccccacttccaagtgttttttgttttgttttgctttgtttttgttgttgttgttttgagacagggtctcactgtgtcccccaggctggagtgcagtggcacaatgacgactcactgcagcctcaacctcctggggccaagtgatcctcccacctcagcctctcaagtggctgggaccacagaagtgcaccaccatgcctggcttttttttttttttttggtcgagatggggtgtccctgtgttgcccagactggtcttgaactcctggactcaagggatcctcctgtcttgggctcccaaagtgttgggattacaggcgtgagtgaccatgcctagctcacttccaggtttaacagacaaaataaacttactctagtttccatctctatcattttataataaccgtagcccacattgtagtagtttttcagctctttactaagtcccaccaattcatgttttcacccttaaaatctttctcactgatactctctctggacagaaaaaaggtgaaataagcctactataaggaatatatgacatgctaaattttatttttaaacggttcttcaagtcagattaaagtaataatagcaaattatgtgattatccatgtcccagcctctctccaaaaaaatagtaaacaagatgtcttcttcttttcccaaagatacacatacacacatgtacaaatttttttatcagataataatagctaatatttaatgagtacttaccttagtttgtcccctttacaacagctttacatctgtgtgattgatacagttcatattcccattttataactgagaaaactggtgcacagagaggataagcaacttgccaaaggtcacacagttaataagtggaaatgctggggtatgaaccaggtagtctgcccccatagctctgccccccagagctgtactgtctcccatgagggtacttctccatggagcagcctgaggcgatccctttattctgggcttctctcagaaatggattcccacacagtattcaaagcaaatttccccagaggaaatcctattggaagaacttaaaaactcagaatctttttctttgtccagagagttgaggaagcttaagctaaatgatacatgtttttaaaaaaaaatcagattataaatttagtttttggtgattcattaaattctttactattatagttattttctagctgttcatcttttagctaaatttgttccaaagaagcaaaagtttggtttctactaagttctggattctggatgggagattgcactgtgtgtgacatgcaagtttcatggtgtgggagattgcagagcatttgggttactgcttttactctttggaagctgttatcatctgtatctgctttaaataaagttaaagatttggaacaaa

SEQ ID NO: 126180 - DNA, 687 bp, Homo sapiens
  Payload ID: 4745
  Gene Symbol: DTX3L
  Gene Name: deltex 3 like, E3 ubiquitin ligase
  Uniprot ID: Q8TDB6
  ENST ID: ENST00000383661
  CDS Start-End: 1-687
atggcctcccacctgcgcccgccgtccccgctcctcgtgcgggtgtacaagtccggcccccgagtacgaaggaagctggagagctacttccagagctctaagtcctcgggcggcggggagtgcacggtcagcacccaggaacacgaagccccgggcaccttccgggtggagttcagtgaaagggcagctaaggagagagtgttgaaaaaaggagagcaccaaatacttgttgacgaaaaacctgtgcccattttcctggtacccactgaaaattcaataaagaagaacacgagacctcaaatttcttcactgacacaatcacaagcagaaacaccgtctggtgatatgcatcaacatgaaggacatattcctaatgctgtggattcctgtctccaaaaggaagaacacccaaacccaggaaagagataccctggaatacagcgaactgcatacttgcctgataataaggaaggaaggaaggttttgaaactgctttatagggcctttgaccaaaagctgatttttacagtggggtactctcgcgtattaggagtctcagatgtcatcacttggaatgatattcaccacaaaacatcccggtttggaggaccagaaatgtatggctatcctgatccttcttacctgaaacgtgtcaaagaggagctgaaagccaaaggaattgagtaa

SEQ ID NO: 126181 - DNA, 2029 bp, Homo sapiens
  Payload ID: 4746
  Gene Symbol: DTX3
  Gene Name: deltex 3, E3 ubiquitin ligase
  Uniprot ID: Q8N9I9
  ENST ID: ENST00000337737
  CDS Start-End: 338-1381
ctcagtcatgtgaccggcaatggcggcgctgacgagagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactc

SEQ ID NO: 126182 - DNA, 791 bp, Homo sapiens
  Payload ID: 4746
  Gene Symbol: DTX3
  Gene Name: deltex 3, E3 ubiquitin ligase
  ENST ID: ENST00000550300
  CDS Start-End: 1-519
cagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtgcgacccctcttcatttcctttcccttggctcctcccctttgttccatttccactgagggacccaccaacccctcgctcacggagcctcctaactggagagaaccacttccaaactgttcagccatctcagtttctcctacattcaacctggtcctggtgtgcccagcttagcctacaaaaataagcagaactgggctaaattatcttggatttggaggtgtcctcccttaggggaggtggggaggtgtctgagccacctagaatgagggtgagcatggggataatagcaagttcaaacagctaacaaccctcaccctcatttctctttgctcccaggtttgggtacccagaccccacctacctgacccgggtgcaagaggagctgagagcgaagggtatcacagatgactgaaggacatcgcctttgccaaggcccctgctgtctgcctctactag

SEQ ID NO: 126183 - DNA, 3199 bp, Homo sapiens
  Payload ID: 4746
  Gene Symbol: DTX3
  Gene Name: deltex 3, E3 ubiquitin ligase
  Uniprot ID: Q8N9I9
  ENST ID: ENST00000548198
  CDS Start-End: 1505-2548
agtcatgtgaccggcaatggcggcgctgacgagaggtaggtgagcccggcgccccccacacccaccgcgcgccccccgggccccgctcgcacccctcacgcgccccccgctcccccggcgccccctcctccacctcccctccccgcgcgcggctccgggctccccgctccgtgcccggccgatcatctttctagcaccctccagccttggcctccattcgggggttctgagggctgcgatcgggccgacatgcacccccacccggcggtggggatccgggggctttggctactgagggatgtggggagttggttccgggtcgggtcttggaggaggccgtggggggagggcgggagctgcttcagtggatgcccccagggacccttgcccatccgggctgtgcctccctctggcctctgtctggagggagagactggttccttgtccggcctgggttgccacagaggaatcacagacccaccctaaactggggccccgcctcccttttctgtgccagcaggacttggacctaggacacctaggtcctgggtcccccgtgatggggagagaagtgttgcatcgcggatagactgtatgggctgagactctagggttccattttcacttatgaatctcgaggtgcatctggccttgggggacgatgatggaggcatgaagggacagctgctccttcttggatcagtcaataaatggaggtcacactaatggcccttctttctgtttgagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaaggtgacaatgagaactttgttattgcaggggctgctgccactttgttcacatccttaacagacttcagcagaagggactgagttagctctcaaggaaggctccctggcaataggggctgaattatttggcaatgtggagcaggcgaggagttggggagcataggaaatattccggtccatgtgatctgagggaggtggcaagaagacctccacctgtgtgggcgttttctttcctgacttctcttatgtgtgccctaggctttcttgggggcctcagagctggggaagaaaggaggaaggttagcatgttgaagttccttcttgagcaacttggggagaagctgataatggaattctgcagagaagagaggagatggaaggggagtttttatttctgggttggctgaggggaatggtaacatttgccatcataactttttacccttcccccactcccagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactcttt

SEQ ID NO: 126184 - DNA, 2270 bp, Homo sapiens
  Payload ID: 4746
  Gene Symbol: DTX3
  Gene Name: deltex 3, E3 ubiquitin ligase
  ENST ID: ENST00000548478
  CDS Start-End: 1689-2270
catctttctagcaccctccagccttggcctccattcgggggttctgagggctgcgatcgggccgacatgcacccccacccggcggtggggatccgggggctttggctactgagggatgtggggagttggttccgggtcgggtcttggaggaggccgtggggggagggcgggagctgcttcagtggatgcccccagggacccttgcccatccgggctgtgcctccctctggcctctgtctggagggagagactggttccttgtccggcctgggttgccacagaggaatcacagacccaccctaaactggggccccgcctcccttttctgtgccagcaggacttggacctaggacacctaggtcctgggtcccccgtgatggggagagaagtgttgcatcgcggatagactgtatgggctgagactctagggttccattttcacttatgaatctcgaggtgcatctggccttgggggacgatgatggaggcatgaagggacagctgctccttcttggatcagtcaataaatggaggtcacactaatggcccttctttctgtttgagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaaggtgacaatgagaactttgttattgcaggggctgctgccactttgttcacatccttaacagacttcagcagaagggactgagttagctctcaaggaaggctccctggcaataggggctgaattatttggcaatgtggagcaggcgaggagttggggagcataggaaatattccggtccatgtgatctgagggaggtggcaagaagacctccacctgtgtgggcgttttctttcctgacttctcttatgtgtgccctaggctttcttgggggcctcagagctggggaagaaaggaggaaggttagcatgttgaagttccttcttgagcaacttggggagaagctgataatggaattctgcagagaagagaggagatggaaggggagtttttatttctgggttggctgaggggaatggtaacatttgccatcataactttttacccttcccccactcccagtcctggtcagctgagtggaaatagaaggatttctgctgccatcatcttccatgggctttccaggtcacacgacctacaagtagggagcagggaaagaagagtgagcctgcatgccaattctaagctcttcaggatcaaagtaagcaaaaaggaggggcaaagagtctccctcccctttaaacagcccatttttccccaagaggtgggaggggcaagttgtttctatgatctgggagaaatgacaggagaaacaagactgatacttggcttagatgataatatagctctggaaacttttttgctcttcagtgggttttgggtttggaagataaggggagacagaatatgaatttgggtgaagggttggggattaggctttgagaaaacagaggtaatagagggtttggaaggaacctgaagtaggaggcactgatacttgtcaaatggggaccccccaccctgagtccctttcaccctgggggcagtgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatg

SEQ ID NO: 126185 - DNA, 1840 bp, Homo sapiens
  Payload ID: 4746
  Gene Symbol: DTX3
  Gene Name: deltex 3, E3 ubiquitin ligase
  Uniprot ID: Q8N9I9
  ENST ID: ENST00000551632
  CDS Start-End: 136-1188
ccggcaatggcggcgctgacgagagtcctggtcagctgagtggaaatagaaggatttctgctgccatcatcttccatgggctttccaggtcacacgacctacaagtagggagcagggaaagaagagtgagcctgcatgccaattctaagctcttcaggatcaaaaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactcttta

SEQ ID NO: 126186 - DNA, 569 bp, Homo sapiens
  Payload ID: 4746
  Gene Symbol: DTX3
  Gene Name: deltex 3, E3 ubiquitin ligase
  ENST ID: ENST00000550596
  CDS Start-End: 548-569
atttttgttttggggaggaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggctttcttgggggcctcagagctggggaagaaaggaggaaggttagcatgttgaagttccttcttgagcaacttggggagaagctgataatggaattctgcagagaagagaggagatggaaggggagtttttatttctgggttggctgaggggaatggtaacatttgccatcataactttttacccttcccccactcccagtcctggtcagctgagtggaaatagaaggatttctgctgccatcatcttccatgggctttccaggtcacacgacctacaagtagggagcagggaaagaagagtgagcctgcatgccaattctaagctcttcag

SEQ ID NO: 126187 - DNA, 2067 bp, Homo sapiens
  Payload ID: 4746
  Gene Symbol: DTX3
  Gene Name: deltex 3, E3 ubiquitin ligase
  Uniprot ID: Q8N9I9
  ENST ID: ENST00000548804
  CDS Start-End: 376-1419
catttttgttttggggaggaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgtgcggccgcttctatgggcagctggtgggcaaccagccccagaatgggcggatgctggtctctaaggacgccaccctcctactgcccagctatgagaagtacggcaccattgtcatccagtacgtcttcccgcccggtgtccagggggctgaacacccaaacccaggagttcggtatcctggcaccacacgggtggcctacctcccggactgccctgagggcaacaaggtgctgaccctgttccgcaaggcgtttgaccagcgtctcaccttcactatcggcacgtccatgaccacagggagaccgaatgtcatcacctggaacgacatccaccacaagaccagctgcacagggggaccccagctgtttgggtacccagaccccacctacctgacccgggtgcaagaggagctgagagcgaagggtatcacagatgactgaaggacatcgcctttgccaaggcccctgctgtctgcctctactaggacccagcagaagcctctttctcctctctgccccctgccccccacaccacacctgtaggggacctgtctgactgggaagggagttccgagagggagggggcaatcccttcccccatcccccactggccaagtgtttcaatgcagtgtgagccactcccttctggcagaggccgacctccaaggctctgttctcccctccccgtgtacatatactcccggtttccctgcccctccattgcccttggctttttctggtatgtgctgtgctccacgaccaagccgagaaaggacctagggtggggaagggagggtctcttgattcctaaccgcccccacatactgctccaccgctgaacttcgggtgccggggaggagaaattgggctgatgtgagctccccgtcacccgccatggagccggctgtgtgtgttcatcagatacagttctcccttaaccttgtcctttctctcctgtgtctcagtctccgtcagtctgtctttctccgctcttctctgacccctgtgaggaacctccttaccctgttctggaatcgctgccagactgtagcttttaatttaataaaaataaagtaaaatatgcaactc

SEQ ID NO: 126188 - DNA, 1331 bp, Homo sapiens
  Payload ID: 4746
  Gene Symbol: DTX3
  Gene Name: deltex 3, E3 ubiquitin ligase
  ENST ID: ENST00000549583
  CDS Start-End: 719-1331
ggaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggacttggacctaggacacctaggtcctgggtcccccgtgatggggagagaagtgttgcatcgcggatagactgtatgggctgagactctagggttccattttcacttatgaatctcgaggtgcatctggccttgggggacgatgatggaggcatgaagggacagctgctccttcttggatcagtcaataaatggaggtcacactaatggcccttctttctgtttgagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaaaatggcagcctgtggaggcacctgcaagaacaaagtgactgtgtccaagcccgtgtgggacttcctgagcaaagagaccccagcccggctggcccggcttcgggaggagcaccgtgtgtccatcctcatagatggcgagacttctgacatctatgttctccagctttccccacagggtcctcccccggcccctccaaatgggctctacctagcccggaaggctctcaaggggctgctaaaagaggcagagaaagagctgaagaaagctcagaggcagggggagctgatgggctgcctggctctggggggtggaggggagcaccctgagatgcaccgcgcaggcccaccccctctccgagcagccccacttctgcccccaggagctcgggggctcccccctcctcctccccccctgcccccacctcttcctcctcgccttcgggaggaggcagaagagcaggagagcacctgccccatctgtctgggggagatccagaatgccaagacattggagaagtgccggcattcattctgcgagggctgcatcacccgggctctgcaggtgaaaaaggcctgccccatgt

SEQ ID NO: 126189 - DNA, 561 bp, Homo sapiens
  Payload ID: 4746
  Gene Symbol: DTX3
  Gene Name: deltex 3, E3 ubiquitin ligase
  ENST ID: ENST00000551835
  CDS Start-End: 416-561
atttttgttttggggaggaagggcaggggcttgcggatagaagggggtcaaaggaacggtgattatcacctgtgaggggaaagggggtgctgtcctccctccttcccttttcctcagcctgcaccccctgcaatcccccacctttcggggtctccccctccttgttgctaaggcccggaccgtcatcccagcaacagcctcagtcatgtgaccggcaatggcggcgctgacgagaggctttcttgggggcctcagagctggggaagaaaggaggaagtcctggtcagctgagtggaaatagaaggatttctgctgccatcatcttccatgggctttccaggtcacacgacctacaagtagggagcagggaaagaagagtgagcctgcatgccaattctaagctcttcaggatcaaatgtcgttcgtcctgtccagaatggcagcctgtggaggcacctgcaagaacaaagtgactgtgtccaagcccgtgtgggacttcctgagcaaagagaccccagcccggctggcccggcttcgggaggagcaccgtgtgtccatcct

SEQ ID NO: 126190 - DNA, 5642 bp, Homo sapiens
  Payload ID: 4747
  Gene Symbol: DTX4
  Gene Name: deltex 4, E3 ubiquitin ligase
  Uniprot ID: Q9Y2E6
  ENST ID: ENST00000227451
  CDS Start-End: 105-1964
ggcgcggtcgaggcccggaggcggcggcgcaggaggaagcggaggaggtcgggcgctcggggcccgggaggcgggccgcgcagcgccgcagccccgggctcgccatgctcctggcctcggccgtggtggtctgggaatggctgaacgagcacggccgctggcgtccctacagcccagcggtgagccaccacatcgaggcggtggtccgcgccggcccccgcgcggggggcagcgtggtgctgggccaggtggacagccgtctcgcgccctacatcatcgacctgcagtccatgaaccagttccgccaagacacgggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactgaggccagaaaagctttgaggtgggaggggccatggagactgcaggacaggaagtgaggagagtgagtcaatgtagaagaagttggtgtcctgccctcccaactttctatcctcccctcctgccctgtgtccatccctcatccctcccaaccacagtgggagccagactgaatatagcgacatcattcataaatctcatccaacacaaagggagatgggatgagggccatcctgggtctgttcccatggagtttttggtgctgggtaggcaggaatcccctccctaccccacctcccaagtaggggcatggtcagcacacctagggtatgggcagtgcttaggcactccatatcctggctttgggaagccggggtttcttgcctcagccggcttcttgctacttccactctgctttgagactggagtttctgctattctccctctgctggaggcagggagctctcactgtgcaaggttggggggtgggcaaaggggtgaatcactaaactgctgtgacatcagaaactgatgccttggtgtagagcaaggaagcacttcttcccaagagggtcggagaaggaaaagcctctgggagcacattctgctgtcatcacagtccttggcttctctgggccctcctctcctcctcacagctctcacctgtccaaagaggcatctggttctctcatgtggatggatggactctggggttcctctttggagtggcatcccatgatgctgtttctagaccctctctgatcaaaccagagcctgcatcccactgagcatctgaactgtcctcagggagaggagcccacagccttcttcccaactcattctagaccagctcaaagattccatgagtttcatcgagtcactgtgagtggagcccatgctgggctctgtgccctctgtgtctgtgcatgcgcgtgtgtgtgtgggcgtgtgtgcattgctgggccagcttgaagggaaggcccgtcatgtccctgcactctgttttgcaagatgccaaaccccagttctgatggggctccaacagccaggctgtggtcctttgacgttcctcacctgttgccaacctatcccgtagtgaactgaaaccccaatgaagacagaactgtgcctggggagatgcaatgaggtgagggctgaactcatccttttatatttcttttcaagattggatcagagctcatctccatccagtcttgtttctatgaaggcttcaatctgtttccatgcaaatttgctaatcagagcccagagctgctgggtccctcatctccctcatctattatagattgacttacagcagggagagaatctctttagctcattcctaatggagttgggatcacaatatggtctggtccaatctgcatcttgttgtgtcccaagaccctatctcctccccaacattcttattgcctttggctcccagtaaggaacgaattgggggccagggaggagaacaggggggatcaagaagggaaacccaattccccctttgaaagtgggttctttgaactatgtgtttgggggaagttcctctggatactaatttgaatttatatacctcatgttttgggggtttgacgtatatatatatatatatatatgcatatatatttcataatatttggaaggtttttgatgctagaaaaatggaaacaagagaaccttcaaaaatggtacttagatgggaactggaggccaatctttcataaagccagccccatagctgcttgctgttaggcctccagccattttgacattggggtggatagtcgattcacctgcctgtcagtcgattcacctgcctgtcacccagttctgtggatgtgctggtgctgagcctttgctctctttccaaatggttacagggatgttgatcagctccaccagagggagctctgatgggaggaattgctctgccatccttgtccctgtgtctcctgtcggcaggcagccattgtatctcaccagcagaccaggagactggtcccaaggttactgcaccacagggcaatttcctgccatagttaggaaggaaacacctgaactaaatggaagagacatccctgcggtgtttaatatcacacccatgccctttgtcaggttaccatgtacagagattacttggagagcctcatgccgtctctaccttcgcacactggtcaagtatctgctgagcttcttggccgcaaggatgcagaaataggctgagggtccatgggaagaaagacacaatgaggcagtaggaggtggggaagaaaagaagacagactttcaaaatggaattaggcactggggagagatcagtttccccacatcagggagaagaaggtataggtggggaagggggtggccaggagcagaaggaagaagactcaagatggaaagggagccgctgtgcctgtggcaataccacttggagaggtcgacttcataccttcaagccttttcccctgggcttttgattgtgtctgtgccccctttcttgtcctctctgcagatgcccagtaggggctacctcatcctcgtgctgttcttgtgtggctttctgggcagtagggatcttgaatttcctttctaacactgtgcccggcaaggcggggagcattcctctgccctttgtcttgtgccaacctggaaaggtgcagtctagatttcagtgagaaccctgccagctgagccctgtgcatctactaccttgacacagagtgttttcccactagaagctctgctctgctctcctggcccaagtaggggattccatgccttccctttcatggtcttagcaccagcagcctagtttctcccttccagagtctccagggatgacaaattggattggagacaaacctcgtcagatgctcatcccctaaaaggttaattgtgtatttgtggctgcgtgtgcctttgtgttttcattctcttcccatttttgtacattttggtcttctctgtggttttatacttggtcaaaagtactcgtcttggtattgcactgttgtgtgcatgagaaaactgggggaaggctcactggtacaagaaaggacccctgacccctttccttctctgtggtccccggcattagattgggggttctgggagaggcaggtgaatgtcctaagtgaattgttctgtttgtaactggaatgtttttgaagtctttggtgttgctccgtgaaaggacatcgccacctggtgctcatgaggtgtctttgcagaacaataaatggcaaatgaacaaccacaaaattgttactcttgttggccttctgctgtttgtagattagtgcacctatctgtgagggatttgggttacctccctgagtctgtaagcaaccacaagccctgccactgggtgggggaagtccctccccaaccacttaaaaacaaattttccacatattacccacccacacatttgacctggctagactttgtttgcctaaaggaacagaccacattgctgggaaaatgagtaagtgaacgtgtgggagaaaaacacttttagaatcacgaatattcacttttaaaggtctctttgcctggctgcaatatagtgtgtgtttaaattatttacaggctgttgtttctcaaataaatgtttaatattaatcattcccaaactgacaagaacacaaaaataaaatgcaaatacagagcc

SEQ ID NO: 126191 - DNA, 1708 bp, Homo sapiens
  Payload ID: 4747
  Gene Symbol: DTX4
  Gene Name: deltex 4, E3 ubiquitin ligase
  Uniprot ID: Q9Y2E6
  ENST ID: ENST00000532982
  CDS Start-End: 167-1708
tgcgtcttcctgactctagtacgttgaatctggccagaaaaaccacatttgctctctacgaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactga

SEQ ID NO: 126192 - DNA, 2554 bp, Homo sapiens
  Payload ID: 4748
  Gene Symbol: DMTN
  Gene Name: dematin actin binding protein
  Uniprot ID: Q08495
  ENST ID: ENST00000265800
  CDS Start-End: 273-1490
gttgcctggttgtgagagtcaggggagcagggacaggtccaagacaaggaaggcagttgggctgtgggaatggggagcccagggaaggcctccagagctggcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaca

SEQ ID NO: 126193 - DNA, 2772 bp, Homo sapiens
  Payload ID: 4748
  Gene Symbol: DMTN
  Gene Name: dematin actin binding protein
  Uniprot ID: Q08495
  ENST ID: ENST00000358242
  CDS Start-End: 494-1711
gagaaaagatgaagaaagccaagaaaagggaccagaagagaaagcagaaagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctccagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggtctccagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 126194 - DNA, 2601 bp, Homo sapiens
  Payload ID: 4748
  Gene Symbol: DMTN
  Gene Name: dematin actin binding protein
  Uniprot ID: Q08495
  ENST ID: ENST00000381470
  CDS Start-End: 389-1540
agagaagcctatcgacagggcctgggggagggaggaggcagcagggccggagtccacccaggacatctggcaccagtgaccttgtggggaaaggagccaagaacggggcgtcggggggcctgggacccccctgcctgagagatacaggaatcctggccccgtgttgtggacacaagcgcccatcctcaaggtcctgagaactcctgaacttccaaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 126195 - DNA, 2415 bp, Homo sapiens
  Payload ID: 4748
  Gene Symbol: DMTN
  Gene Name: dematin actin binding protein
  Uniprot ID: Q08495
  ENST ID: ENST00000443491
  CDS Start-End: 278-1354
aggttgtcttggcaacaggaggtggagaggagatgcgccgagggatggaggtgtatgtcaccgaggaggctgctgcgctcctgccccacgccctgggcccttgaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 126196 - DNA, 2394 bp, Homo sapiens
  Payload ID: 4748
  Gene Symbol: DMTN
  Gene Name: dematin actin binding protein
  Uniprot ID: Q08495
  ENST ID: ENST00000415253
  CDS Start-End: 188-1339
ataattcacttactgtctgcaccagccggcctccagcctggctggaccctgctgcctgtgtggcccggagccagaggcccccacactcccagctgctcttctacagatgccatcaacgagcaggactctgggtggctccactgtctaagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgg

SEQ ID NO: 126197 - DNA, 2508 bp, Homo sapiens
  Payload ID: 4748
  Gene Symbol: DMTN
  Gene Name: dematin actin binding protein
  Uniprot ID: Q08495
  ENST ID: ENST00000432128
  CDS Start-End: 230-1447
tctctgaggaagaggcagcgggaggcacagcttcctcctccccccctccctgctgccgcggctgagccgggcctgagctgccggcaggttgtcttggcaacaggaggtggagaggagatgcgccgagggatggaggtgtatgtcaccgaggaggctgctgcgctcctgccccacgccctgggcccttgaagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggtctccagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 126198 - DNA, 2735 bp, Homo sapiens
  Payload ID: 4748
  Gene Symbol: DMTN
  Gene Name: dematin actin binding protein
  Uniprot ID: Q08495
  ENST ID: ENST00000523266
  CDS Start-End: 463-1680
ccagaagagaaagcagaaagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctccagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgg

SEQ ID NO: 126199 - DNA, 616 bp, Homo sapiens
  Payload ID: 4748
  Gene Symbol: DMTN
  Gene Name: dematin actin binding protein
  ENST ID: ENST00000522148
  CDS Start-End: 402-616
gcgggctcgggtttcctgggctcgcgcggcgcggcccgtgctacctgttggggaagaaaacccgagcccccggaggggccggggccggggccgggacgtgcatccagccgggccccgggccccaggccccaggcccgaggcgcaggcgagggccctgcggagcccggcggagcccgggcggcccgcggacgccaggagcctcctcgggcagcgagattgctttttttccgcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatcccc

SEQ ID NO: 126200 - DNA, 813 bp, Homo sapiens
  Payload ID: 4748
  Gene Symbol: DMTN
  Gene Name: dematin actin binding protein
  ENST ID: ENST00000517804
  CDS Start-End: 210-813
ccctaagccggcatttttcctgttatttgtgctccggggaagcgccgcggggttcctggaagagacacctattacctaggctcctgggggaagtgacagcccgtggatctggcctacgcctctcgggcctctgtggcctcagagcgtctgggccacactgtctgggaagagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtgg

SEQ ID NO: 126201 - DNA, 581 bp, Homo sapiens
  Payload ID: 4748
  Gene Symbol: DMTN
  Gene Name: dematin actin binding protein
  ENST ID: ENST00000523623
  CDS Start-End: 138-581
acagaaagccgagaggctgggctgaggccgggctggttgtggagcgatggctggagtggctcctcctccaaggctgtgcccctttctgccacattgaagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagttt

SEQ ID NO: 126202 - DNA, 601 bp, Homo sapiens
  Payload ID: 4748
  Gene Symbol: DMTN
  Gene Name: dematin actin binding protein
  ENST ID: ENST00000523300
  CDS Start-End: 115-601
ctgcggagcccggcggagcccgggcggcccgcggacgccaggagcctcctcgggcagcgagattgctttttttccgggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcg

SEQ ID NO: 126203 - DNA, 2235 bp, Homo sapiens
  Payload ID: 4748
  Gene Symbol: DMTN
  Gene Name: dematin actin binding protein
  Uniprot ID: Q08495
  ENST ID: ENST00000523782
  CDS Start-End: 104-1180
gggatggaggtgtatgtcaccgaggaggctgctgcgctcctgccccacgccctgggcccttgaagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgg

SEQ ID NO: 126204 - DNA, 2658 bp, Homo sapiens
  Payload ID: 4748
  Gene Symbol: DMTN
  Gene Name: dematin actin binding protein
  Uniprot ID: Q08495
  ENST ID: ENST00000519907
  CDS Start-End: 446-1597
aagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctccagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 126205 - DNA, 977 bp, Homo sapiens
  Payload ID: 4748
  Gene Symbol: DMTN
  Gene Name: dematin actin binding protein
  ENST ID: ENST00000517418
  CDS Start-End: 374-977
ggagcagggacaggtccaagacaaggaaggcagttgggctgtgggaatggggagcccagggaaggcctccagagctggccggcctccagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtgg

SEQ ID NO: 126206 - DNA, 1057 bp, Homo sapiens
  Payload ID: 4748
  Gene Symbol: DMTN
  Gene Name: dematin actin binding protein
  ENST ID: ENST00000520174
  CDS Start-End: 404-1057
gatcagaccgctcagccgagaccagctcccctccttcgccagctcccaccccgcccacccaccctaagccggcatttttcctgttatttgtgctccggggaagcgccgcggggttcctggaagagacacctattacctaggctcctgggggaagtgacagcccgtggatctggcctacgcctctcgggcctctgtggcctcagagcgtctgggccacactgtctgggaagagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaag

SEQ ID NO: 126207 - DNA, 587 bp, Homo sapiens
  Payload ID: 4748
  Gene Symbol: DMTN
  Gene Name: dematin actin binding protein
  ENST ID: ENST00000519850
  CDS Start-End: 256-587
agagaagcctatcgacagggcctgggggagggaggaggcagcagggccggagtccacccaggacatctggcaccagtgaccttgtggggaaaggagccaagaacggggcgtcggggggcctgggacccccctgcctgagagatacaggaatcctggccccgtgttgtggacacaagcgcccatcctcaaggtcctgagaactcctgaacttccaaagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctca

SEQ ID NO: 126208 - DNA, 2551 bp, Homo sapiens
  Payload ID: 4748
  Gene Symbol: DMTN
  Gene Name: dematin actin binding protein
  Uniprot ID: Q08495
  ENST ID: ENST00000517305
  CDS Start-End: 273-1490
gttgcctggttgtgagagtcaggggagcagggacaggtccaagacaaggaaggcagttgggctgtgggaatggggagcccagggaaggcctccagagctggcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggtctccagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 126209 - DNA, 1569 bp, Homo sapiens
  Payload ID: 4748
  Gene Symbol: DMTN
  Gene Name: dematin actin binding protein
  Uniprot ID: Q08495
  ENST ID: ENST00000517600
  CDS Start-End: 249-1346
gagatgcgccgagggatggaggtgtatgtcaccgaggaggctgctgcgctcctgccccacgccctgggcccttgaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcaca

SEQ ID NO: 126210 - DNA, 593 bp, Homo sapiens
  Payload ID: 4748
  Gene Symbol: DMTN
  Gene Name: dematin actin binding protein
  ENST ID: ENST00000522340
  CDS Start-End: 379-593
gtcatttcctttgaagccagagaacaatggctcaaaaacaagcgcagcccgtccttcggtcgcctcccgtccacgcgcgcgttctccggggctgagcggatgggaagcctcagccgcaaggggcccggctgcctggagagcggccgcccgcggaggccccgcagcctaacgccgccccggcgcggcctccctcccttctccccgcagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccct

SEQ ID NO: 126211 - DNA, 582 bp, Homo sapiens
  Payload ID: 4748
  Gene Symbol: DMTN
  Gene Name: dematin actin binding protein
  ENST ID: ENST00000519333
  CDS Start-End: 361-582
agagaacaatggctcaaaaacaagcgcagcccgtccttcggtcgcctcccgtccacgcgcgcgttctccggggctgagcggatgggaagcctcagccgcaaggggcccggctgcctggagagcggccgcccgcggaggccccgcagcctaacgccgccccggcgcggcctccctcccttctccccgcagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtg

SEQ ID NO: 126212 - DNA, 3749 bp, Homo sapiens
  Payload ID: 4749
  Gene Symbol: DDN
  Gene Name: dendrin
  Uniprot ID: O94850
  ENST ID: ENST00000421952
  CDS Start-End: 23-2158
ggccggggtggggtggggcaggatgctggatggcccactgttctccgaggggcctgacagcccccgggagctccaggatgaggagtctggcagctgcctctgggtgcagaagtccaagctattggtgatagaagtgaagactatttcctgtcattatagtcgccgcgccccttctcgacagcccatggacttccaggccagccactgggctcgcgggttccagaaccgcacgtgtgggccgcgcccgggatccccacagccgccgccccgccggccctgggcctccagggtgctgcaggaggcgaccaactggcgggcggggcccctggccgaggtccgagctcgggagcaagagaaaaggaaagcggcgtcgcaggagcgggaggccaaggagaccgagcgaaaaaggcgcaaggctggtggggcccgacggagccccccgggtcgaccccgcccggagccccgcaacgcccctcgggtggcccagctggcagggctccctgctcccttgcggccggagcgcctggcgcctgtggggcgagcgccccgtccatccgcgcagccgcagagcgacccagggtcggcgtgggcggggccctggggaggtcggcggcccgggcccccaagctacgaggctcacctgctgctgagaggttctgccgggaccgccccacgacgccgctgggaccggccgccaccctacgtggctccaccttcttacgaaggcccccataggaccttggggactaagagaggccccgggaactctcaggtgcccacttcatcagccccagctgcgactccagccaggacagacggagggcgcacaaagaagaggctggatcctcggatctaccgggacgtcctcggggcttggggtctccgacaggggcaaggtctcttggggggatccccaggctgtggagcggccagagcaaggccagagcccggcaagggggtcgtggagaaaagcctggggctggctgctgctgacctgaacagtggtagcgacagccatccccaagccaaagctacagggagcgcaggcaccgagatagctcctgcggggtctgcaactgcggctccctgtgccccgcatcccgctcccagatccaggcaccacctcaagggctcgagggaagggaaagaaggagaacagatctggtttcccaaatgctggattccctcccctaaaaagcagccgccccgccatagccagacactccccagaccctgggctcccggaggcaccggatggagagaatctctgggtcttggagagggggcaggaccggagaccctggagggttggaaggcgacccgccgtgcccacaccttgccccgcagttcccagggcctgtcccgtggggaaggcgtctttgtcattgacgccacgtgcgtagtgatacgatcccaatatgttccaaccccccgaacccagcaggtgcagcttttgccctctggggtgacacgcgtggtgggggattcccccagccaatcgaagcccggcaaggaggagggtgaaggggccacggtctttccttccccttgtcaaaagcggctgtcgagcagtcgccttttacaccagcccggcgggggccgcgggggcgaagctgagggcgggaggccgggggactccacactggaggagcgcactttccgcatcttggggctcccggcccccgaagtaaacctgcgggacgcccccacgcagccaggtagcccagagcaccaagccttaggcccagcagcttcgggagcccagggcagagccgaggggtcggaagtggcggtggtccagcggcgcgccggccggggctgggcgcggaccccagggccctacgccggggccctgcgagaagccgtgtcccgtatccgccgccacacagcccctgactcggacacggacgaagctgaggagctcagcgtccatagcggctcctctgatggaagcgacacagaagccccgggcgcctcctggcggaatgagaggaccctgcccgaggttggaaacagttcgccagaggaagatgggaagacagcggaactgagcgacagtgtcggggagatcctagatgtcataagccaaaccgaggaggtcctcttcggggtgagggacatcagagggacccaacagggaaataggaagaggcagtgagaggccccttcttgtatttgtgtccccaacgcatccatccttgggtccactggtccccattcttccccacagacttcctttgcttctcttttccttgtatctttacccatacctgttctcatccttgaaatataaatgaaaggaagggaagcatatgcccattaatgattttgtttcaggagaggtgagaatgagcagatttaattaatgtctgttatgttcagggcacaagggtgagctcttcgcaggggctgatgcactgggtgtggagctgagcagagaggcctaaccaggatcaggcaggagggcagggatggtggcagccataggagggcagggtagggtagggcctctgaggaggagggaaaaagtgaaggagaggctttggacctggtgacagagtgatcagatgacagaggggttcttgggagaagaggcataggtccagcaacaaccaacaaagcagaaggagggctcaccttggtgtcacaagtcttggatttcaatcccaactctgccactgagttgctggttgactgaggccagtcactttccctctccaggcctccaggcctcctggtatataaaatgatggtattctaaggtccatccttccgtctctgacattttgagatctttggaaaggactctatctcatcctcccctcgacaagccaagaatgagaattgggaataagtgaacagagtttgagggtttctgggcggcctccgtgtcacccaaagtcatgatcaattcaggagactgcccaaggcttgcagaagaggtaagggagtgaggcactcctatcccagtctcccaggtttggttgagggctccccaaggcagggcaagatagcggccctgtcactgaccctggcctgtggtggtctgagctggggagggaaggacaccaatgaatcagcttgggacctctttaggccttccccttttcctccaccccgatgctccttagtgatgctctgaggcgtggccacgatctccctcccaggtggtatcgcccacctgaaaaaatcctgagaatttctcccatcttggcctcttccagaaaccggccaggcaaggaaagaggccggtcaccagaagccagcaggcgtggggtgtgatactctctatagccactacagggcgcgcgcaggtcgcggatctccccagttgctaatcccggctctgccactcaatcctatccctagttcccgagcgcgggtcccccgccttgcagtctccagccgtgcggggccgggagcaggcctccggcctcccagacttctagagcccgccgggcccatctttgtactcatccaccccagccggcttgggactcagacaccgaagtctttttttttttctctccgatccttggacacctcctctgtctgccatttattagccatgtgaacttggccacatcacttcacctccctgagcctcagtttcctcatctgtcaaatgggggtttataaacacctacctcgcagggttgttgtgaggatttaatgcgataatgtatgtaaagcgccttgcacactgcctggcacacagtaggcgctcaataaatctaagcttcccttta

SEQ ID NO: 126213 - DNA, 3135 bp, Homo sapiens
  Payload ID: 4750
  Gene Symbol: DCANP1
  Gene Name: dendritic cell-associated nuclear protein
  Uniprot ID: Q8TF63
  ENST ID: ENST00000503143
  CDS Start-End: 241-975
cagaacccaagggcttacctgtgctctgtgattccccaactagggatttagttgtagccacggacctggtaggcaacagggaggggattttaatctgctccttgcatcagaaggtccaataggcagggttagtataatgggagatgccctggtagggctggcaaggagaagaagccacatgtattttggtctgatgaaaagcagcagtgatctgtcactgaccaaaatggtcccccaactatgcattacggagcagcaacccacatacagaactcgagaagccacggcctggagactgtacctggacaccaaagactggagagaggagctggtggggaaaccccagagttcccagggtgccactccccagctccaccagagaactttgggaatgagctgctgcccctgagtgcccctctccagggcctcagtgagggtctctaccctccagggaggaacaaaaccttgccagctggggtcctgcgagagggggcagttcaattcctccacaggggactctgcaactccaatctttcgagtgaagcatctgcgaggccctcagggacccaggatgaactgcatagcagcagaaggaagacaggccagaccaggcgggagggagcccggaaacatctggtttgtagtttcagactctacccgttcacagttcacacagtctcaccgggaaactcacaccttgccctgtaccaagtttttaaggcagttaagctctgcccatccgagacttcatttttcttgagtagaaaatcactgaaatcatcagatccatggcacccaccttcactttctcctaacagctggaaccgtcaggctggcttcagggcctggtcttcgcacttgatatcactatccctcacctgctcagacagccagagcaggcgggtgagttcctcccaacaacctccactgcattctctcagctcccaccgcagggcagcccacgtgcctgagtgaacatgtgtgcgtgtgcacacacgcaagtatgcacagacatacactaaacacgaacatacagtgcacatgaacgctgctcccagctagggccctctggtcagactgctgcctgggttagaattcttgtccccacccccacttactatagttctgtgatcctggacaagtaactgaatctctccgtgccacagtttcttcttgtagaaaacgggaaagttcacagtacttacctccttagagtcattgtgaaggtcagtttgaggcatcacaaatttaaggcacccagacataagggtcaacagggttagctatcactgtccagtttggtgggaggaactgaatgcatgtaggcacatggacccagtctacactcaggcacaaaaggagctacattagttacattcaggcataccccagagcactacaattctctgagacattgtctggaaatctagaaatcatctccttgccctttaaggtattttaaccctcgcattcctctgcttttccaagaatgtgaatcttgccaagctgtccgtgagagacacgggctcccctcgagggagacttgcaaatgctccataaacagccacagtgtggggctctgccatgaggaagtcacagcagacacgctagacagcatagtcctggatgcaacctggaggaagggaggcccatggtggagcactcactccgtgcctgtctgcccggtgagacctcaagttccttgcagacaaaggccatgggttgttggctcttgtgttcccggtggcctttccagagctgaacagaggacagatgcacagacgggggggctctggtggtcaaggcagcagtccccttggatactaaagtctgagccaggcccctcaggcccggcatgggcagtgcgaggcccatagtggtgggaagccagttggccagctggggtgagaaggccgcgaagccatgggcagacaggaagtggaggtgaatgtctctgcctcctgtaggcctcagcagggacagcacagaccctctggctggggcagcgcagaccctctagctggggcagaacaaggctggtgcttccttctagtccttgagactttgtagctctaactcaagcagaaccctggggttttgggattctgtgtggtgactgctgaggaaggtttatggatttgacagggtgcatgtcacagagagacagttctcagtcagcacttcctgtcccctgcagaggctcataggggacagcccctgccaaggagaccctggaggggctctgaggatagcaatcagaggttgggctggctggactgagcccaggcctgttgcccaccaagtctccataggttctagtctgacccctctctccacccctgggctatgcaggccagcccgtgcagaccacccccgacgcgtccacttgcaacacccgcctcactgtgccaacactccatccacacaggaaaggactgagaacgtgatgcttaacccaaaggagtgagtttcataggatgggtggctttaacagtttcacagcaggacactgagggaatatttccctatcccttcaaatggacggtcactacagaaacgtgtagagcaagactttgtcaaggggctgtttccaggtctcccggtgtctaaatagcagagctggaatgggaactgagaaccgattctttccacaaccgcccactgagcagcaaggctgcagccagcaaagaggtgcggaggcaagcaagctccatgtggtggggacagcgcattgcgacctccaccacccctgcagtgggctgccagctgagccacctgtcttccactgtatctactgtacgaacttctccagctctgctctgttttctcttcctcagcatccaccccgtgacacgtagtggtggctgatgtcgccacagtaccatgaggttaacaggtcctccctccagcttccctcatggtggcagcctaacctgcattgcagccgttcaccggacaccgcaccagaccctcaaaacccatccaagactgtgggaggagtaaacaacccagcccagttaagaggagatgccgaatttaatgaaccctatttgaattgcagggctgtgattcctcttacctttaacgtgaactcacaggcggattaaagtgaaataaaacctaccatttgagtta

SEQ ID NO: 126214 - DNA, 1953 bp, Homo sapiens
  Payload ID: 4751
  Gene Symbol: DCSTAMP
  Gene Name: dendrocyte expressed seven transmembrane protein
  Uniprot ID: Q9H295
  ENST ID: ENST00000297581
  CDS Start-End: 50-1462
gcatttctgcattcgaagaagaatctgagagaaacctgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaagtatgtcatcatcccgactttctggccgactcctaaagaaaggaaaaacctggggctgtttttcctccccatacttatccatctctgcatctgggtgctgtttgcagctgtagattatctgctgtatcggctcattttctcagtgagcaagcagtttcaaagcttgccagggtttgaggttcacttgaaactgcacggagagaaacaaggaactcaagatattatccatgattcttcctttaatatatctgtgtttgaacccaactgtatcccaaaaccaaaattccttctatctgagacctgggttcctctcagtgttattcttttgatattagtgatgctgggactgttgtcctctatccttatgcaacttaaaatcctggtgtcagcatctttctaccccagcgtggagaggaagcgcatccaatatctgcatgcaaagctgcttaaaaaaagatcaaagcagccgctgggagaagtcaaaagacggctgagtctctatcttacaaagattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaccca

SEQ ID NO: 126215 - DNA, 949 bp, Homo sapiens
  Payload ID: 4751
  Gene Symbol: DCSTAMP
  Gene Name: dendrocyte expressed seven transmembrane protein
  Uniprot ID: Q9H295
  ENST ID: ENST00000517991
  CDS Start-End: 13-864
gacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaaattcatttctggcttccagtcctgaaaatgattaggaagaagcaaatggacatggcaagtgcagacaagtcatgagagaccccgactactcctcagccacatcgcaccaa

SEQ ID NO: 126216 - DNA, 1471 bp, Homo sapiens
  Payload ID: 4751
  Gene Symbol: DCSTAMP
  Gene Name: dendrocyte expressed seven transmembrane protein
  Uniprot ID: Q9H295
  ENST ID: ENST00000622554
  CDS Start-End: 80-931
atatatcaagacctacagcccttgggaagtgcatttctgcattcgaagaagaatctgagagaaacctgacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttgcctttgcagggctttcgctcgtcctgcttggcactggcctcttcatgaagcgatttttgggcccttgtggttggaagtatgaaaacatctacatcaccagacaatttgttcagtttgatgaaagggagagacatcaacagaggccctgtgtgctcccgctgaataaggaggaaaggaggaaattcatttctggcttccagtcctgaaaatgattaggaagaagcaaatggacatggcaagtgcagacaagtcatgagagaccccgactactcctcagccacatcgcaccaacaattctcttcaggtctaggatggcagtcactattcatgccggataatagagaactatgtgacgcagtcctctcaggagtctgagtttacagagccaacttgcagcacctggttatgcctcctttcatctcaaagccaaagagctgccaggtaaatggttatgtggtctatgttccaaacaaaccacatgatcttgcctgtgtcacaatgtaacaagactctagctgggtcccctggtgatgagtttcagcatagaataatgttcaaggaaaagaaaacgaaaacagtttaaatctctaccacagcctcacaagcaaatgctaaggggaacatacatgtaaaaagccagcaaactatcttcaaactcttccgtccttaatgtcttccatggctattgcccccacaatggtctcttttctccctgctcccttattaaagaactctttctgaaaccc

SEQ ID NO: 126217 - DNA, 3003 bp, Homo sapiens
  Payload ID: 4752
  Gene Symbol: DENND1A
  Gene Name: DENN/MADD domain containing 1A
  Uniprot ID: Q8TEH3
  ENST ID: ENST00000373618
  CDS Start-End: 294-1694
ggcggagggggcggcgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggcgttgtgaatccccaaaaggagcaagacagaagacagcatttctcagatttgcctggctggggaacctccttttttcccttcacacaatgcgtctcccaggatggtgtttctcagcagacaccctgtgagatgccggccttccactgagatgatttcatctgccaagtgccaagactgggtggacatttttttaagtcctctctggaaacaaatgtaggcgatggactgggagggggagaggctggaggcagggaaacctgctgatggtaatggttgctaatgtctgttggtggcactgtgcaaagaacctgacgtccatcatctcgttgaatcttcctaacaggacactcgggtaggcagtgctgttacctgtacttcacagatgaggacagtaaggcttggaatggtcaaatcgtgggcctggagtaacccagggagtaaatgggagaactggggttctctccaaaactgtctgacccctagaggctgcctcccgagcgctctggtgcactgccacccagcaggaatggaaatagcccaagccagaggtgacaagcagtgaagacagtggggctggagaagatggttcccccgaagtagaaaggccaagcataagagaagcagtattgtggggagtggtgtaggagagctgggtgtctagacagggtagcagcctgtgcaccggtggagggggtgggctcccctctccctgatcacctcttcctcttgatgaatggtgtgaattgaggggtgggggggctgttcccctttcccccacacacttcctgtaagccaggaaggggaaaaaacatggtggccttgcccatccctaggcagcacccccaactcccgggtagctgtcagctgaagggtcaccaagcatgggtcagccctcacgcccagctaatggcataggatctgggaagccacggtgtcattctatcccatcgtgttctccatgtgccgccagggaaccctccaccaagtccctggacccgctttcccctcaggctgccccgacaggttccatgcagagcaccagggacccagggacaactgggacacaggccctgccctccaggagtagtggggcaggttcagaaaacaaattctaaggcagatttgagatctgaagtgtcactcccactcagtagagccctatatcagcactgtccaagaaaaacataatgggagcttcatacgggagtcacatgtggaattctgaatgtgaaacataaacaggtgaaattgattttaatataatgaacccaatatatccaaaatattatttcaacatgtaatcaatctaaaaatta

SEQ ID NO: 126218 - DNA, 3612 bp, Homo sapiens
  Payload ID: 4752
  Gene Symbol: DENND1A
  Gene Name: DENN/MADD domain containing 1A
  Uniprot ID: Q8TEH3
  ENST ID: ENST00000373620
  CDS Start-End: 222-1901
acgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcaaaacaccattgcaacaccagctacactccacatcctacagaaaagcattacccattttgcggccaagttcccgacgagaggctggacctcttcatcacattgacttacgccgttgcttttccagactgggcagaggggctgacttcgcagtgtgtgccaaagagccggtgtctgataatcccattttcctgcttatcacctgaactgtgtcagtatcacttttagttttgttggttggttggtttgttgtttgtttaatatgccctgttttctacttctgttggaaaatatttggggttgaaataaaccagtgggagcatgggagccagtttggtggttggcaaactaccagtgatagaaaacaaatgacaggttttctgtgagcgtacgtcacagtggctcgggcccacaaggagacagaggggtacgtttcaggacatcattccaagggtttctgttcacgtttgtttaacgaggaaggggaagttgttctcccataataccagtggtatttctagtgcaacccgggtgtttttctacgcctcttcccatgctgcttccccacccccccactgtgctccgccccttccaaatgccatgtcacaacagcacttggatgtgtttttctcaactgtcatcagctccagctggcaggaccaacttcttgaaacacaggaagcatccagcggaaaatattttaataaaacagactcctcataaaatattgttcgggggagggggaagaaaccggctccaccaatctgtcggcattgtattgggagatgtgagaagccaggctggcagcaggggcccgatcctaatgggcctttgtcaggtggtggttccgtgttgggcacacggacttggtgcctggccctttaatctggcctgggttttcttgaatcacagatcttcatctccactgggaatatcaaagtgcttgggaaacttagaagactggggcagcagaaggggatgcaggatctttgaagtggagaggagagattcattcctcctgacttcttgccccaactctcacttccaattgcacattaaataatcccagcactttgggaggccaaggcgagcggatcacctgaggtcaggggttcgagaccagcctgggcaacatggcgaaaccccgtctctactaaaaatacaaaaattagccgagtgtggtggcgcacccctgtaattccagctactcgggaggctgaggcatgagaatcacttgaacccaggaggcggaggctgccgtgagctgagatcacaccaccacactccagcctgtgcaacagagtgagactctgtctcaaaaataaaataaccagctttgtggacagcaagatggggctgattaagagtaagactgtctcctggagtagctgagcatcctgggactcatcagggcccagaaacactagccagccactctctggccagtccacccctgaagttcatttcttccttcccagctgatgtccatccctccatcattccatctgtccattcgtgcattcattcattcagcaagtatctttgaaaacctactaggcgcaagcacggacgatttttttaaaggaggccttaaaagggagtccccatgctgactcttggttgacttgcattttcccaaaatgaaattttcctgtgtcaaattttctttctgaatcaatgataggtttcctagtcccttaaaactggccgttggcaattggaagaagacttttttgaagatttgtgggggaaacattccctttacttttcaggtaacattacttggttaatattcagttactaaatctcttcaagaa

SEQ ID NO: 126219 - DNA, 5010 bp, Homo sapiens
  Payload ID: 4752
  Gene Symbol: DENND1A
  Gene Name: DENN/MADD domain containing 1A
  Uniprot ID: Q8TEH3
  ENST ID: ENST00000373624
  CDS Start-End: 203-3232
gcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcagccctgctcggaaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaagagg

SEQ ID NO: 126220 - DNA, 1380 bp, Homo sapiens
  Payload ID: 4752
  Gene Symbol: DENND1A
  Gene Name: DENN/MADD domain containing 1A
  ENST ID: ENST00000394215
  CDS Start-End: 1-1380
agctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcaaaacaccattgcaacaccagctacactccacatcctacagaaaagcattacccattttgcggccaagttcccgacgagaggctggacctcttcatcacattga

SEQ ID NO: 126221 - DNA, 4508 bp, Homo sapiens
  Payload ID: 4752
  Gene Symbol: DENND1A
  Gene Name: DENN/MADD domain containing 1A
  ENST ID: ENST00000394219
  CDS Start-End: 1-2730
agctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcagccctgctcggaaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaagagg

SEQ ID NO: 126222 - DNA, 2195 bp, Homo sapiens
  Payload ID: 4753
  Gene Symbol: DENND1B
  Gene Name: DENN/MADD domain containing 1B
  Uniprot ID: Q6P3S1
  ENST ID: ENST00000235453
  CDS Start-End: 279-1469
gggggccggacggacagccccacaccgacatgtaaccatggactgcaggaccaaggcaaatccagacagaacctttgacttggtgttgaaagtgaaatgtcatgcctctgaaaatgaagaggacagtccagcttatctgccgaggattccccctggaaaagtacgccgattcgcattttgcattaagaaactggaaaactttcctgtcggtcctggcgtagcgcctcccgtgtccggggtagaccttgtaccggctgaaaccgcatagctcgaccttcatggcggcagctccacgggaggagaaaagatggccccaacctgtattttcgaatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggaggtaaagacaagttacaatatgattatccattttctcaataacaattttcttggtctttgcacttgtgtctgataaaacctatttcataaacaactaatgatttcctcctaaatatgtaatgtcttaaatacatttttcatcttataaaagctatggaattagcttattttgcctgatacctgttactcaaggcattaagttggcctcctgaattggcagctgttggcctcgataatctcttaatattgctggaaattagtaatacagaaatccaatcaactcatatcttcctgtctttccttctgaatagtagtattctctgctagaaaactactagtgatggttattactgagtatgaatttaagaactgaggttatgattggtaatacaatccaaaaagaagggtctgaacaccaaaattctttatacatatttaagtaactgtattattattatacagatgtctttacctttttgactttatagatcactgcagcattaagaaagtttccagtttaccattccataagtacaattaatccttctagtgtaaatgttcaaatactgttataattatctaggcaattaataatttacaaactgatatttttgcacgattgtagtggtgtatagtcttgacttgcagagcattttgcttgagtccttgaaatgtcgtgttcattcattatttgctgagtgcttacaatgtattaggcactgttctaaatattaagtgtactaaataaacaaaaatccttgtattctg

SEQ ID NO: 126223 - DNA, 3043 bp, Homo sapiens
  Payload ID: 4753
  Gene Symbol: DENND1B
  Gene Name: DENN/MADD domain containing 1B
  ENST ID: ENST00000294737
  CDS Start-End: 153-1211
atgggcccgccgccacggctgctgtgagcagcctctttccctgtgtggccgccggcgtgggcggggacggcgcgaccctcgcgcggccgggctgcgggcttccaggccagcgcgcgggggccggacggacagccccacaccgacatgtaaccatggactgcaggaccaaggcaaatccagacagaacctttgacttggtgttgaaagtgaaatgtcatgcctctgaaaatgaagatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtgtgtatgtatgtttaaagtatgtattgaccatgagatttcccagtgtttggtgcttaatgccgtttattttatttaagctaagaatgcatatgtaacccatgcacataaccagtagctactatactaatctggttgagcatgaactgatcaagatatcaaaacttatcaaaactagcctgaagctgatgaaactgttaacccactaattgccttaatcttaaagctgttttttaagcatacttaaataatgtatgaaagtatgtataaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgac

SEQ ID NO: 126224 - DNA, 2177 bp, Homo sapiens
  Payload ID: 4753
  Gene Symbol: DENND1B
  Gene Name: DENN/MADD domain containing 1B
  Uniprot ID: Q6P3S1
  ENST ID: ENST00000367396
  CDS Start-End: 171-1451
gccgggggcgcagccgacatgggcccgccgccacggctgctgtgagcagcctctttccctgtgtggccgccggcgtgggcggggacggcgcgaccctcgcgcggccgggctgcgggcttccaggccagcgcgcgggggccggacggacagccccacaccgacatgtaaccatggactgcaggaccaaggcaaatccagacagaacctttgacttggtgttgaaagtgaaatgtcatgcctctgaaaatgaagatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgaaccaagagatatttattgcctgtgagcaagttctgaaagatcagcctgctctagtaccgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggaggtaaagacaagttacaatatgattatccattttctcaataacaattttcttggtctttgcacttgtgtctgataaaacctatttcataaacaactaatgatttcctcctaaatatgtaatgtcttaaatacatttttcatcttataaaagctatggaattagcttattttgcctgatacctgttactcaaggcattaagttggcctcctgaattggcagctgttggcctcgataatctcttaatattgctggaaattagtaatacagaaatccaatcaactcatatcttcctgtctttccttctgaatagtagtattctctgctagaaaactactagtgatggttattactgagtatgaatttaagaactgaggttatgattggtaatacaatccaaaaagaagggtctgaacaccaaaattctttatacatatttaagtaactgtattattattatacagatgtctttacctttttgactttatagatcactgcagcattaagaaagtttccagtttaccattccataagtacaattaatccttctagtgtaaatgttcaaatactgttataattatctaggcaattaataatttacaaactgatatttttgcacgattgtagtggtgtatagtcttgacttgcagagcattttgcttgagtccttgaaatgtcgtgttcattcattatttgctgagtgcttacaatgtattaggcactgttctaaatattaagtgtactaaataaacaaaaatccttgtattctg

SEQ ID NO: 126225 - DNA, 6960 bp, Homo sapiens
  Payload ID: 4753
  Gene Symbol: DENND1B
  Gene Name: DENN/MADD domain containing 1B
  ENST ID: ENST00000391979
  CDS Start-End: 1-1248
gtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtgtgtatgtatgtttaaagtatgtattgaccatgagatttcccagtgtttggtgcttaatgccgtttattttatttaagctaagaatgcatatgtaacccatgcacataaccagtagctactatactaatctggttgagcatgaactgatcaagatatcaaaacttatcaaaactagcctgaagctgatgaaactgttaacccactaattgccttaatcttaaagctgttttttaagcatacttaaataatgtatgaaagtatgtataaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgacaaaaaaaaaaaaaaaaatctttttttaactaataattctctatcaaaatgcttcatatcatcatctcaaatttactttttaaaataattgactttgtattttagaagttttagatttacagaaaaattgcaaagatagtacagagagttcccatctacccctgttactaacatcttacgttactatggtacatctgccccaattagtgaaccaatattgatattccatactttattcagattttcttagttttctcctaatatccattttccacatcaagatcctattcagaataccacactatattgagttggaatgtctccttaggctcctcttgcctgtgacagtttcttagactttccttatttttgatgacattgacagctttgaagagtactgtcagataaattgtagcatgctcctctcttggagtttgttgggtatttttttcatgattagactgggattgtgggttttgaggagatgatcacagaagtaaagtgccattttcatcaggtcatatcaagggtacgtactgtcaacatgatttgtgaatgctgacagggaccttgataacctggctgaggtagcgtttgtcactctaaagttcttcctgccctttccatgctgtcatttttggaaggaagtcactacatgcaggagtgaggagtcataattccccttctttagggcagagaagtatctacataaataactgggaattctgtatagaaaatttgtttcttctttctcaaattcactgttgagctttggaattcatctgagaaggaatcatgtactaattacttcatgatagactagattaccaggcacaatcagggaaaaaagcagtgatagtatggttaaattgttattagcattttcagtatatccactttatacatccccaatcatgattttttttacatttctttttagaaaagatgttcaagaaatcattaaagaaccccaataagactatattctaaatatttattgaaagaatataatttcagctaaaatcctagaagagggtttgaaataatttaaagaaaatgaccaagtttttttaaaacctacgtttcaaaatctaaatggatatgtgttatttgggacacttattcattatgattatataagaagacaattcttgtttcccttataagtatggactgtatacattaaggaaaacaatgtttaatccttattttttaatacagaagtctcaaggttcttgtcaaattttgcctttataagcttattacaaaattacaacttactttactgaagtttataatggaagaagtccatatagcaaaagagctgttttaaatcagaaggaaaaaaggttactctggttgttaatctgcttggcaaatattccttcataatttgtgaaaagaatgcaaatcagcattttaatatgaattttgaaatgaggtatggttttttgtttgtttttttcagaactcagtctgaaaaacaactgtgagtgtagcatgggtcaaatttggtttttagtccatttgctttatcaacatcacggcttcagaaatccaaattttgttctacttttcagccacctttcaaggtgtttggttataatactgtgttgctttgaggatatttagccactcataaataattgtctcaaggtatttaaaagtgatttgtgccttattttaatgcaaaattagcagttttattctattttaaaaacaaaggcagaaaaacaattctgcatgttattctttaaaaacatccagaataatactaccaagtatttgtatttcaaaccagtaaaattttgaatattcaaagtctgctcttaaacttagacttcctagtattatggtggttatagtgagaatgaaattaaactgggtgagttccgaaataaaggaaagtgttatattctacagtgcccatattttctatggtaactaaatcaaatatttgtaagttcctctgctttttgaaattatttttcaaagaagcaacacctgttatacaacagaattgtataaactaaaaagacttttggccttggtacatagtctttatctggcctgcaatggagtcatggttctttctgaatcccactctcacttttttctttttacccttagatattgcatccgtggtatttcaggggtatagagaaataatattggaatttaggagctatttttttaagtgaaaatattactaagtggtatcttttgatgattacctactttaatgtgtcttagaaaagcaccaaaacatagcatgattattttttcagttaattaaaattagttaataacatgttcatttaaaaactattcattgactttttgtaccagtcatatgcagggtacagtaactgaggatatgggaaataaaataactgacatagtccctgctctgaaggaacaaaggaaaaggaattgcaaatttttattaaaataataataataataataataataataataataataataataatgtgttttgcctggaagttattagctgagattctaacacacaaaaagttcaaaaaaaaagaacaaaaactggctgcttaatttaaagcatgctctaagtatgaaccatagtatcatttctaatttcattaactttctcaattattatgctaagtatattatgctgctaagatacccacatttaaggggcagatttagagactcttttagaaactgagtgtctttatcttattatcagataaccaggctgcacagggctctctataatggaatgatgctccttttcaatacttagagccactgtactcagtttaggagtaactgaaggtgtggatgcatgttaatgggaatccaatttttactatttttatatgaataacagcgttctgtagaaacagtctctcccttctaaataaaaactatgtgactgctgttactagtgctattctatgcgaatatcctaataataggattcaggaattctaatgaattgtttcttaattaaggtgaacaagtagactcctgatcaagaggagaacactgtgaatgtctcataatcaatagaccttcattctcttgtagaaaatgtggattttcaggaaaagactgattattttcatgaataaattttcttatacaaattccattttgtttgacataaaagaccctgaatcttaagatatttgtaaatcagaatatttaagaatgtaaaatgaatccccaaatctagtttcctccaaagcacttcttaatgtaggaaatagtttttacaaaccctatgtcagtactaatgttcctgggtcaaacccagtaatattgttagtgtatgttgttacaccttatttaagaggcagagtggttttgagcaagtcagttaacgtgatttgatgaagaaataaggaattatatacatttagacagaagaatattttattttgaaaataggatttcgtgcaataatttttcttgcataacttagttcatataaatatgtacatctgtttttctggcagatgccttaaggtcatgtttttcagtatttgagtaaatctgtatgtagcaatgttctcattgatttcagaaaaaaatatattctttatattgttgccaggagaaatgtttttgtttatttaaaattattatggatattgtgttgttgtatcataactaactgcctcagcaacaataaatatgcaataagaaaatcctgtaccttagattagattgacaatactgttactttaaaagaaatatatacggtacaaattgctgattctacatgtgtacatttaacagatactcagttctgcaccacctaaatcaaaatggcatttgtatgctgatgattacatatgtggattgtagtatcctttgtgatgaatctttgataagatttataaagggcattgccaatactttttgactgtgtaaattaattttttgtatgatgtacagtttgtttaatcttagagcttctatagatttctactttattatacttgaatgaggcagaaaagcactgtggaaaatctgtagctctggatgcaacatgcagacataccaaaaaaataataataaagcaaggtactgaagagcaatgttaacagaatgctttatatccagaatgctatgtttttttcaagccacattttagttgaatgaagtaaagttattcaatcttttattttaaaatattggaaagtcacaaatgattacttctttgatatgatgaacctataagtctattcatctctgttatttcatttctcaaatgtgagccttgttgaggtccattatcaaatctacactttggttgattatatgatgtttaggacaaggcagaatttaaaacctgcatgtttagtgcatcacatgtcaagtcaccatccttctgacagtgtaacttccataacgttattttgagagccatttaataatcatatttgaaaaagtggatttcttgagtctgttgtagtttagtacttacagcagtgcctaaaacagcaactaatatgaactgcctgagtcctacaacataaatgcataaagcttttttatgtaaaagccacaggaggggttcaaaattgaacttttccaaagtttatttctcttgcgttagatgaaaaactatttaaaaggactgaaaaccctgagctttttgctcgtcttggtagcagatatctgtaaaaacctacccagaattgtgattttacttcattgttcttgcatccttgaggctacagtataaatcatctccaaacttgactactattgggaagatgtgtataaaagcatcgctttgggaatttttttaaaaatatgcaaaaataaatattgaataaaatctacattaccataaaacacccaaaaatgcagttctaaaataaaattggtcacaattaaa

SEQ ID NO: 126226 - DNA, 583 bp, Homo sapiens
  Payload ID: 4753
  Gene Symbol: DENND1B
  Gene Name: DENN/MADD domain containing 1B
  ENST ID: ENST00000422998
  CDS Start-End: 142-583
actagcgctccccctgcaccctctggccgcccgggcgcggggacctggcccccgcctcctccacagtctccgacttgcgagccgcacggcccagggcaaatccagacagaacctttgacttggtgttgaaagtgaaatgtcatgcctctgaaaatgaaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgcattcctacttcattgcccctgatgtaactggactcccaacaatacccgagagtagaaatcttacagaatattttgttgccgtggatgtgaacaacatgctgc

SEQ ID NO: 126227 - DNA, 8375 bp, Homo sapiens
  Payload ID: 4753
  Gene Symbol: DENND1B
  Gene Name: DENN/MADD domain containing 1B
  Uniprot ID: Q6P3S1
  ENST ID: ENST00000620048
  CDS Start-End: 339-2666
gacttcctgatttgcaagaaggtgcaggagccgcagcgggcggccccggtcgcaggaactgagaggcctcagctttggtggcggctaccggcggagacgggggcggcggccacgccaccgctgctgtcacagaaaggctctggtgggtggggtgggaggcggggaagtgccgggggcgcagccgacatgggcccgccgccacggctgctgtgagcagcctctttccctgtgtggccgccggcgtgggcggggacggcgcgaccctcgcgcggccgggctgcgggcttccaggccagcgcgcgggggccggacggacagccccacaccgacatgtaaccatggactgcaggaccaaggcaaatccagacagaacctttgacttggtgttgaaagtgaaatgtcatgcctctgaaaatgaagatcctgtggtattgtggaaattcccagaggactttggagaccaggaaatactacagagtgtgccaaagttctgttttccctttgacgttgaaagggtgtctcagaatcaagttggacagcactttacctttgtactgacagacattgaaagtaaacagagatttggattctgcagactgacgtcaggaggcacaatttgtttatgcatccttagttaccttccctggtttgaagtgtattacaagcttctaaatactcttgcagattacttggctaaggaactggaaaatgatttgaatgaaactctcagatcactgtataaccacccagtaccaaaggcaaatactcctgtaaatttgagtgtgaaccaagagatatttattgcctgtgagcaagttctgaaagatcagcctgctctagtaccgcattcctacttcattgcccctgatgtaactggactcccaacaatacccgagagtagaaatcttacagaatattttgttgccgtggatgtgaacaacatgctgcagctgtatgccagtatgctgcatgaaaggcgcatcgtgattatctcgagcaaattaagcactttaactgcctgtatccatggatcagctgctcttctatacccaatgtattggcaacacatatacatcccagtgcttcctccacacctgctggactactgctgtgccccaatgccatacctgattggaatacactccagcctcatagagagagtgaaaaacaaatcattggaagatgttgttatgttaaatgttgatacaaacacattagaatcaccatttagtgacttgaacaacctaccaagtgatgtggtctcggccttgaaaaataaactgaagaagcagtctacagctacgggtgatggagtagctagggcctttcttagagcacaggctgctttgtttggatcctacagagatgcactgagatacaaacctggtgagcccatcactttctgtgaggagagttttgtaaagcaccgctcaagcgtgatgaaacagttcctggaaactgccattaacctccagctttttaagcagtttatcgatggtcgactggcaaaactaaatgcaggaaggggtttctctgatgtatttgaagaagagatcacttcaggtggcttttgtggagggaacccgaggtcatatcaacaatgggtgcatacagtcaagaaaggaggtgcactgttcaacacagcaatgaccaaagcaacccctgctgtacggacagcatataaatttgcaaaaaatcatgcaaagctgggactaaaggaagtgaagagtaaactaaaacacaaggaaaatgaagaagattatgggacctgttctagttctgtacaatatacaccagtttacaaattacacaatgaaaagggaggaaactcagaaaagcgtaagcttgctcaggcacgcttaaaaaggcctcttaagagccttgatggtgctctatatgatgatgaagatgatgatgacattgaaagagcaagcaagttatcttctgaagatggtgaagaagcttctgcttatctctatgagagtgatgactctgttgaaacaagagtgaagactccttactcaggtgaaatggacttactaggagagattcttgatacattgagcacacacagctcagatcaggggaagctggcagctgcaaagagcttggatttctttagatcaatggatgacattgattacaaacctacgaataaatctaatgctcctagtgagaataacctggctttcctctgtggtggttctggtgaccaagcagagtggaatcttgggcaagacgatagtgccctccatggcaaacacctccctccatctcctaggaagcgggtttcctctagtggtttgacagattctctgtttatcctgaaagaggaaaacagtaacaagcacctcggtgctgacaatgtgagtgaccctacttcaggactggatttccaactcacttcccctgaagtttcccagactgataaaggaaaaacagaaaagagggaaacactaagccagatttcagatgatctgcttatacccggtcttgggcggcattcatcgacttttgttccttgggagaaagaagggaaagaagccaaagagacttcagaagatattggactgctccatgaagtagtgtcattatgtcatatgacatctgacttccaacaaagcttgaacatttcagacaaaaacacaaatggaaaccaaacttaaatcttgcatccaagcttctatggagacattttgagattcaatgcaatctgtataataaacagaattatttgtaggaatggcaactcatactatttaaatttttttttgcatttgcaacatttttctcacttgttcatttcgaggatatatgaaatgcattgatttttaaatataaagcgaattctactgtgcttttaaatcaggtactagtgtgtatgtatgtttaaagtatgtattgaccatgagatttcccagtgtttggtgcttaatgccgtttattttatttaagctaagaatgcatatgtaacccatgcacataaccagtagctactatactaatctggttgagcatgaactgatcaagatatcaaaacttatcaaaactagcctgaagctgatgaaactgttaacccactaattgccttaatcttaaagctgttttttaagcatacttaaataatgtatgaaagtatgtataaagtttgaaggataagttattagtgttctgcagagcaataatgcctttttctattcatcaaatcaaggtcaaaattcatcttttcaagattaaaaagctctcttaatggaaatatttaatttgcttatataaagcactatagccatgttttccaaaaagtataaaaatatacacttacctttcattcagtgaaatataggaagtgctgaattacaatgtgaagttaatgacttctgtttacaaatgagacactctaacgagttttcagtctctctgtatgcctttgctatttaggggtccaccccaagaaagccaaatacaacataaaccgtcctgacaaaaaaaaaaaaaaaaatctttttttaactaataattctctatcaaaatgcttcatatcatcatctcaaatttactttttaaaataattgactttgtattttagaagttttagatttacagaaaaattgcaaagatagtacagagagttcccatctacccctgttactaacatcttacgttactatggtacatctgccccaattagtgaaccaatattgatattccatactttattcagattttcttagttttctcctaatatccattttccacatcaagatcctattcagaataccacactatattgagttggaatgtctccttaggctcctcttgcctgtgacagtttcttagactttccttatttttgatgacattgacagctttgaagagtactgtcagataaattgtagcatgctcctctcttggagtttgttgggtatttttttcatgattagactgggattgtgggttttgaggagatgatcacagaagtaaagtgccattttcatcaggtcatatcaagggtacgtactgtcaacatgatttgtgaatgctgacagggaccttgataacctggctgaggtagcgtttgtcactctaaagttcttcctgccctttccatgctgtcatttttggaaggaagtcactacatgcaggagtgaggagtcataattccccttctttagggcagagaagtatctacataaataactgggaattctgtatagaaaatttgtttcttctttctcaaattcactgttgagctttggaattcatctgagaaggaatcatgtactaattacttcatgatagactagattaccaggcacaatcagggaaaaaagcagtgatagtatggttaaattgttattagcattttcagtatatccactttatacatccccaatcatgattttttttacatttctttttagaaaagatgttcaagaaatcattaaagaaccccaataagactatattctaaatatttattgaaagaatataatttcagctaaaatcctagaagagggtttgaaataatttaaagaaaatgaccaagtttttttaaaacctacgtttcaaaatctaaatggatatgtgttatttgggacacttattcattatgattatataagaagacaattcttgtttcccttataagtatggactgtatacattaaggaaaacaatgtttaatccttattttttaatacagaagtctcaaggttcttgtcaaattttgcctttataagcttattacaaaattacaacttactttactgaagtttataatggaagaagtccatatagcaaaagagctgttttaaatcagaaggaaaaaaggttactctggttgttaatctgcttggcaaatattccttcataatttgtgaaaagaatgcaaatcagcattttaatatgaattttgaaatgaggtatggttttttgtttgtttttttcagaactcagtctgaaaaacaactgtgagtgtagcatgggtcaaatttggtttttagtccatttgctttatcaacatcacggcttcagaaatccaaattttgttctacttttcagccacctttcaaggtgtttggttataatactgtgttgctttgaggatatttagccactcataaataattgtctcaaggtatttaaaagtgatttgtgccttattttaatgcaaaattagcagttttattctattttaaaaacaaaggcagaaaaacaattctgcatgttattctttaaaaacatccagaataatactaccaagtatttgtatttcaaaccagtaaaattttgaatattcaaagtctgctcttaaacttagacttcctagtattatggtggttatagtgagaatgaaattaaactgggtgagttccgaaataaaggaaagtgttatattctacagtgcccatattttctatggtaactaaatcaaatatttgtaagttcctctgctttttgaaattatttttcaaagaagcaacacctgttatacaacagaattgtataaactaaaaagacttttggccttggtacatagtctttatctggcctgcaatggagtcatggttctttctgaatcccactctcacttttttctttttacccttagatattgcatccgtggtatttcaggggtatagagaaataatattggaatttaggagctatttttttaagtgaaaatattactaagtggtatcttttgatgattacctactttaatgtgtcttagaaaagcaccaaaacatagcatgattattttttcagttaattaaaattagttaataacatgttcatttaaaaactattcattgactttttgtaccagtcatatgcagggtacagtaactgaggatatgggaaataaaataactgacatagtccctgctctgaaggaacaaaggaaaaggaattgcaaatttttattaaaataataataataataataataataataataataataataataatgtgttttgcctggaagttattagctgagattctaacacacaaaaagttcaaaaaaaaagaacaaaaactggctgcttaatttaaagcatgctctaagtatgaaccatagtatcatttctaatttcattaactttctcaattattatgctaagtatattatgctgctaagatacccacatttaaggggcagatttagagactcttttagaaactgagtgtctttatcttattatcagataaccaggctgcacagggctctctataatggaatgatgctccttttcaatacttagagccactgtactcagtttaggagtaactgaaggtgtggatgcatgttaatgggaatccaatttttactatttttatatgaataacagcgttctgtagaaacagtctctcccttctaaataaaaactatgtgactgctgttactagtgctattctatgcgaatatcctaataataggattcaggaattctaatgaattgtttcttaattaaggtgaacaagtagactcctgatcaagaggagaacactgtgaatgtctcataatcaatagaccttcattctcttgtagaaaatgtggattttcaggaaaagactgattattttcatgaataaattttcttatacaaattccattttgtttgacataaaagaccctgaatcttaagatatttgtaaatcagaatatttaagaatgtaaaatgaatccccaaatctagtttcctccaaagcacttcttaatgtaggaaatagtttttacaaaccctatgtcagtactaatgttcctgggtcaaacccagtaatattgttagtgtatgttgttacaccttatttaagaggcagagtggttttgagcaagtcagttaacgtgatttgatgaagaaataaggaattatatacatttagacagaagaatattttattttgaaaataggatttcgtgcaataatttttcttgcataacttagttcatataaatatgtacatctgtttttctggcagatgccttaaggtcatgtttttcagtatttgagtaaatctgtatgtagcaatgttctcattgatttcagaaaaaaatatattctttatattgttgccaggagaaatgtttttgtttatttaaaattattatggatattgtgttgttgtatcataactaactgcctcagcaacaataaatatgcaataagaaaatcctgtaccttagattagattgacaatactgttactttaaaagaaatatatacggtacaaattgctgattctacatgtgtacatttaacagatactcagttctgcaccacctaaatcaaaatggcatttgtatgctgatgattacatatgtggattgtagtatcctttgtgatgaatctttgataagatttataaagggcattgccaatactttttgactgtgtaaattaattttttgtatgatgtacagtttgtttaatcttagagcttctatagatttctactttattatacttgaatgaggcagaaaagcactgtggaaaatctgtagctctggatgcaacatgcagacataccaaaaaaataataataaagcaaggtactgaagagcaatgttaacagaatgctttatatccagaatgctatgtttttttcaagccacattttagttgaatgaagtaaagttattcaatcttttattttaaaatattggaaagtcacaaatgattacttctttgatatgatgaacctataagtctattcatctctgttatttcatttctcaaatgtgagccttgttgaggtccattatcaaatctacactttggttgattatatgatgtttaggacaaggcagaatttaaaacctgcatgtttagtgcatcacatgtcaagtcaccatccttctgacagtgtaacttccataacgttattttgagagccatttaataatcatatttgaaaaagtggatttcttgagtctgttgtagtttagtacttacagcagtgcctaaaacagcaactaatatgaactgcctgagtcctacaacataaatgcataaagcttttttatgtaaaagccacaggaggggttcaaaattgaacttttccaaagtttatttctcttgcgttagatgaaaaactatttaaaaggactgaaaaccctgagctttttgctcgtcttggtagcagatatctgtaaaaacctacccagaattgtgattttacttcattgttcttgcatccttgaggctacagtataaatcatctccaaacttgactactattgggaagatgtgtataaaagcatcgctttgggaatttttttaaaaatatgcaaaaataaatattgaataaaatctacattaccataaaacacccaaaaatgcagttctaaaataaaattggtcacaatt

SEQ ID NO: 126228 - DNA, 2816 bp, Homo sapiens
  Payload ID: 4754
  Gene Symbol: DENND1C
  Gene Name: DENN/MADD domain containing 1C
  Uniprot ID: Q8IV53
  ENST ID: ENST00000381480
  CDS Start-End: 114-2519
gttaaacttcctctctcagccacacaggaagctgagccggcttggggcccagcatacacaggcccccaggacccctggggagagggccccgctgggctggccctgcagggaccatggaatccagagctgaagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctcctcaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatctca

SEQ ID NO: 126229 - DNA, 2395 bp, Homo sapiens
  Payload ID: 4754
  Gene Symbol: DENND1C
  Gene Name: DENN/MADD domain containing 1C
  Uniprot ID: Q8IV53
  ENST ID: ENST00000543576
  CDS Start-End: 116-2389
acacaggaagctgagccggcttggggcccagcatacacaggcccccaggacccctggggagagggccccgctgggctggccctgcagggaccatggaatccagagctgagaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgcgcgcccatgccctacctcattggagtgcacgccagtctcgccgagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctcctcaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatca

SEQ ID NO: 126230 - DNA, 2933 bp, Homo sapiens
  Payload ID: 4754
  Gene Symbol: DENND1C
  Gene Name: DENN/MADD domain containing 1C
  ENST ID: ENST00000590867
  CDS Start-End: 354-1001
cacagccacacacacacagtcacactttctcactccatcctgtacttgtgtgttcaattaacactgctgcacacacagcctcacacaaccacacactcacagccacaaacccccagagtcatgcacatgccgacgcaccttgtggcacatgcacacacaaccacacttgtgtgcaaagtggcagacacaaccacacatgcatagaagcaagtctctggaccccttctgcatcccacagagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatccatccctgagaacaggaacctaacggagctggtggtggccgtgactgacgagaacatcgtggggctgttcgcggcgctcctggccgagagaagagtcctgctcaccgccagcaaactcagcaccctgacctcgtgcgtccacgcgtcctgcgcgctcctgtaccccatgcgctgggagcacgtgctgatccccacgctgcccccacacctgctggactactgctgatgccctcctctgccaaggactcccgggctctgagcggccgaccccgcttttccgcagagagtacgagaaaaagccctggaggacgtcgtggtgctgaacgtggacgccaataccttggagacgacctttaacgacgtgcaggcgctgcctccagacgtggtgtccctgctgaggctccggctcaggaaggtcgccctggcccccggggaaggggtgtcccgtctcttcctcaaagcccaggccctgctcttcggggggtaccgcgacgcactcgtctgcagcccgggccagccagtgaccttcagtgaggaagtcttcttggcccagaagcctggggcacctctgcaggccttccaccggcgggctgtgcacctgcagctgttcaaacagttcatcgaagcccggctggagaagctcaacaagggggagggcttctcagatcaattcgagcaggagatcactggctgcggggcctcctcaggggcccttcgatcctatcagctctgggccgacaatctaaagaaaggtggtggcgccctcctgcactcagtcaaggccaagacccaaccagccgtcaagaacatgtaccgctcggccaagagtggcttgaagggggtgcagagccttctaatgtataaggatggggactctgtcctgcagagggggggctctctgagggccccagccctccccagccgctcagaccgcctgcagcaacgcctcccaatcactcagcactttggaaagaaccggccccttcgccccagcaggagacgccagctggaagagggaacttccgagcccccaggggcggggacacccccactgagccctgaggatgaggggtgcccgtgggcagaagaagctctggacagcagcttcttggggtctggagaagaactggatttgttgagcgagattctggacagtcttagcatgggagccaagagcgcaggcagcctgagaccgagccagagtttagactgctgtcacagaggagacctggacagctgcttcagcctgcccaacataccaagatggcaaccagacgataagaaactaccagagccggagccccagcccctttccctgccatccctgcaaaatgcctcgtctttggatgccaccagctcttcaaaggactccaggtcccagctgataccctcagagtccgaccaagaagtcacgtctccatcccagtcctcaacagcttctgcagacccaagcatctggggggaccccaaaccctctcctctcacagagcccctaattcttcatctcaccccttcccacaaggcagctgaagattctacagcccaggaaaaccccactccctggctctccactgcacccactgagcccagccctccagaaagcccccaaattctggcccccacaaagcccaactttgatatagcctggacgtcccagccccttgatccttcctcagaccccagttctctggaggaccccagagcccggcctcccaaagccctgctggcagagcgcgctcacctccagccacgggaggaaccaggagccctgaattcccctgctacacccaccagcaactgtcaaaagtcccagcccagcagccggcccagagtcgctgatcttaagaagtgctttgagggttaagaatcaggggtccaagagagaccccagtccctcaataaagccacaagagcccaaaaaagctggtttttttcctggtgaatttctctggtgccctcactctgctcggaaatccatcccacccacctctgtccctccaagggcagcctctctaactggctcctagcagggaattccaggaagcctcctggtcttctagaatcctggcaaccttacaattcctctcggcatttgtcacttccatctcagctaatgcacccaccagctcaaacacaccaataaagcttttgttacatc

SEQ ID NO: 126231 - DNA, 590 bp, Homo sapiens
  Payload ID: 4754
  Gene Symbol: DENND1C
  Gene Name: DENN/MADD domain containing 1C
  ENST ID: ENST00000586046
  CDS Start-End: 104-376
ctctctcagccacacaggaagctgagccggcttggggcccagcatacacaggcccccaggacccctggggagagggccccgctgggctggccctgcagggaccatggaatccagagctgagaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcct

SEQ ID NO: 126232 - DNA, 484 bp, Homo sapiens
  Payload ID: 4754
  Gene Symbol: DENND1C
  Gene Name: DENN/MADD domain containing 1C
  ENST ID: ENST00000588421
  CDS Start-End: 220-484
acacaggcccccaggacccctggggagagggccccgctgggctggccctgcagggaccatggaatccagagctgagtaagagccaccccatccctcattctctgagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatc

SEQ ID NO: 126233 - DNA, 571 bp, Homo sapiens
  Payload ID: 4754
  Gene Symbol: DENND1C
  Gene Name: DENN/MADD domain containing 1C
  ENST ID: ENST00000590473
  CDS Start-End: 191-571
acagtagtgcaatcttggttcactatggcctcaaactccccaggctcaggcgatcctcctgactcagcctcctggagggggctcccctgctgtgtttgattggttcttcgaagcggcctgccctgcctccctgcaggaggatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccg

SEQ ID NO: 126234 - DNA, 582 bp, Homo sapiens
  Payload ID: 4754
  Gene Symbol: DENND1C
  Gene Name: DENN/MADD domain containing 1C
  ENST ID: ENST00000590173
  CDS Start-End: 160-582
acacaggaagctgagccggcttggggcccagcatacacaggcccccaggacccctggggagagggccccgctgggctggccctgcagggaccatggaatccagagctgaatccccccatcctgcggcagttccctccagacttcagggaccaggaagctatgcagatggtgcctaaattctgcttcccttttgatgtggaaagggagccccccagccccgccgtgcagcatttcaccttcgccctcacagaccttgccggcaaccgcagatttggtttctgccgcctgcgggcgggtacccagagctgtctctgcatcctcagccacctgccttggttcgaggtgttttacaagctattgaacacagtgggagacctcctagcccaggaccaagtcaccgaggcagaggaacttcttcaaaatctgtttcagcagtccctgtctgggccccaggcctcagtggggcttgagctgggcagcggagtgacggtctccagcgggcagggtatccccccccctacccgggggaatagcaagccgctttcctgcttcgtggccccggactccggccgcctgccatcc

SEQ ID NO: 126235 - DNA, 3735 bp, Homo sapiens
  Payload ID: 4755
  Gene Symbol: DENND2A
  Gene Name: DENN/MADD domain containing 2A
  Uniprot ID: Q9ULE3
  ENST ID: ENST00000275884
  CDS Start-End: 419-3448
gccgcgggcgagcctgcgctgggccggccgagggaagcgcgccgctggggccgggggcggcggggaccccacgggagcgcgcgcggcggggacccccaggggcttgcgggcggccgggggaggctcggcggacaaaggggcggagggcggagggccatggcgtccccggcacccgccgccgcccgcccccgagccgcgccgccagccgtcccggcccgccccggagcccccaagatgcgccccagagcccgcggagccgccgcccgcggggagggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagtaagaaaaatg

SEQ ID NO: 126236 - DNA, 3334 bp, Homo sapiens
  Payload ID: 4755
  Gene Symbol: DENND2A
  Gene Name: DENN/MADD domain containing 2A
  ENST ID: ENST00000461883
  CDS Start-End: 116-2710
agaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgg

SEQ ID NO: 126237 - DNA, 537 bp, Homo sapiens
  Payload ID: 4755
  Gene Symbol: DENND2A
  Gene Name: DENN/MADD domain containing 2A
  ENST ID: ENST00000489552
  CDS Start-End: 266-537
agtgttggcgtatgctttgtacacctgggccacgcagcctgagcccacaggttcccggttctcaaaagagaggatgctcccccagtcatccccaaaagcctgccgaaggaagcgctcagtggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactca

SEQ ID NO: 126238 - DNA, 542 bp, Homo sapiens
  Payload ID: 4755
  Gene Symbol: DENND2A
  Gene Name: DENN/MADD domain containing 2A
  ENST ID: ENST00000477488
  CDS Start-End: 307-542
actcccaggactgagcccggacgccgccgtctcgcgcctcggggacctgcagaaagccggtgacctggaactcccctcggtactgacatgatgacagtgtgcaggccggccaagggcagccacagccagactgaaaacctgagctacaaattggctgacaaggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctac

SEQ ID NO: 126239 - DNA, 800 bp, Homo sapiens
  Payload ID: 4755
  Gene Symbol: DENND2A
  Gene Name: DENN/MADD domain containing 2A
  ENST ID: ENST00000491728
  CDS Start-End: 328-800
cagacccgccttccccgcagcccacggcatttccctgcggacttctgctgtgcagcctgtgttccttgacggtgtcctgcgtgacctggaactcccctcggtactgacatgatgacagtgtgcaggccggccaagggcagccacagccagactgaaaacctgagctacaaattggctgacaaggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctc

SEQ ID NO: 126240 - DNA, 3614 bp, Homo sapiens
  Payload ID: 4755
  Gene Symbol: DENND2A
  Gene Name: DENN/MADD domain containing 2A
  Uniprot ID: Q9ULE3
  ENST ID: ENST00000492720
  CDS Start-End: 248-2635
gtgacctggaactcccctcggtactgacatgatgacagtgtgcaggccggccaagggcagccacagccagactgaaaacctgagctacaaattggctgacaaggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcaggtacccgccttggctacttctgctaaagcgtttgaatgacagtcgctcttggaccctctagtctgtagagcaggtgaccgcctagcattgaagagtaagcccttctgagataaggatggaataggctgggcgcggtgactcacacctgtaatctcagcactttgagaggctgaggtgggtggatcacttgagaccaggagttcgaggccagcctgtgcaacatggtgaaactccgtctctactaaaaatagaaaaattagccagccatggtggcccacgcttgttatcccagctacttgggaggctgaggcacgggaatcgattgaacctgggaggtggacattgcagtgagctgagatctcaccactgcactccagcttgggcaacagagggagaccttccctcctgcccccacaaataaaggatggccaggcacggtggctcatgcctgtaatcctagcacttcgggaggccgaggcaggcggatcacctgaggtcaggagttcaagaccagcctggccaacatgatgaaactcagtctctactaaagatacaaaaatcagccagtcatggtggctcgtgcttgtaacaccagctacttgagaggctgaggtacaagaatcgcttgaacccaggaggcagaggctgcagtgagctgagatcgcaccattgcactccagcctgagcaacagaatgacattccatctcaaaaataaaaataaaataggccaggcgcagtggctcacacttgtaatcccagcactttgggaggccgaggcgggtggatcacaaggtcaagagattgagaccatcctggccaacatggtgaaactccgtctctgctaaaaatacaaaaattagctgggcatggtggcgtgtgcctgtagtcccagctactcaagaggctgaggcaggagaattgcttgaacccaggaggcagaggttgcagtgagccgagatcatgccactgcactccagcctggtgacagagcgagactccatctcaaaaaataaaaaataaaataaaataaaggatggaa

SEQ ID NO: 126241 - DNA, 3562 bp, Homo sapiens
  Payload ID: 4755
  Gene Symbol: DENND2A
  Gene Name: DENN/MADD domain containing 2A
  Uniprot ID: Q9ULE3
  ENST ID: ENST00000496613
  CDS Start-End: 290-3319
aagatgcgccccagagcccgcggagccgccgcccgcggggaggtgacctggaactcccctcggtactgacatgatgacagtgtgcaggccggccaagggcagccacagccagactgaaaacctgagctacaaattggctgacaaggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtgg

SEQ ID NO: 126242 - DNA, 490 bp, Homo sapiens
  Payload ID: 4755
  Gene Symbol: DENND2A
  Gene Name: DENN/MADD domain containing 2A
  ENST ID: ENST00000469373
  CDS Start-End: 1-490
cctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcacacctacatcccggtgctgccacccgccatggtcgacatcgtgtgctcgccgacgcccttcctcatcgggctgctctccagctcgctgccactgctcagggagctgccgctggaagaggt

SEQ ID NO: 126243 - DNA, 828 bp, Homo sapiens
  Payload ID: 4755
  Gene Symbol: DENND2A
  Gene Name: DENN/MADD domain containing 2A
  ENST ID: ENST00000475837
  CDS Start-End: 420-735
ggaggcaggggccgcgggcgagcctgcgctgggccggccgagggaagcgcgccgctggggccgggggcggcggggaccccacgggagcgcgcgcggcggggacccccaggggcttgcgggcggccgggggaggctcggcggacaaaggggcggagggcggagggccatggcgtccccggcacccgccgccgcccgcccccgagccgcgccgccagccgtcccggcccgccccggagcccccaagatgcgccccagagcccgcggagccgccgcccgcggggagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaag

SEQ ID NO: 126244 - DNA, 3452 bp, Homo sapiens
  Payload ID: 4755
  Gene Symbol: DENND2A
  Gene Name: DENN/MADD domain containing 2A
  Uniprot ID: Q9ULE3
  ENST ID: ENST00000537639
  CDS Start-End: 146-3175
ggtcaaggtggaaggtccaaggactgagaaagaccctcgaaggcatccactttagtcctccattccattcctagagactgatcaggagtcaggcttcagaaggagtcccctggaaggcctccacaacctcacgctagagtcaagaatggatatgttcagcttggatatgatcatcagtgacccagctgcagaagccagcagggctgggaagaagcagctcagaggtgttcagaacccttgcccatctgccagagccagaccccggcacaagtccctcaacataaaggacaagatatcagaatgggaagggaagaaagaggtgcccactcctgcacccagcaggagagcagacggacaggaggattatctgccgtcctctacggtggagaggaggagtagtgatggggtgagaactcaggtcacagaggctaagaatggaatgaggccaggaacagagagcacagagaaggagaggaataaaggagcagtgaacgtcgggggacaggacccagagccggggcaagacctaagccagccagaacgggaagtggatcctagctggggccgaggccgagagccaagacttggcaagctacgctttcagaacgatcccctctccgtgctgaagcaggtcaagaaactcgagcaggctttgaaggatgggtcggcagggctggatccccagttaccagggacttgttactccccacactgccctcctgacaaggcagaggcagggtccacccttcctgagaacctgggaggcgggagtggctcagaagtcagccagagggtccacccctcggacctggaaggcagggagcccacccctgagcttgtggaggacaggaaaggttcatgcagaaggccctgggaccggagccttgagaacgtgtataggggctcggagggttcccccacaaagcccttcatcaaccctctgccaaaaccccggagaacgttcaaacatgccggagaaggggacaaagatgggaagcctggcatcggcttcaggaaagagaaaagaaatctgcctcctctgccctctctacctcccccgcctctgccctcctctcccccaccttcctctgtgaacagaagactgtggaccgggagacagaaatccagtgcagaccacagaaagtcctatgagtttgaagatttactgcagtcttcctctgagagcagcagggtggactggtacgcgcagactaagctggggctgacacgcactttatcggaggagaacgtctatgaagacattctagatccgccaatgaaggagaacccttatgaggacatcgagttacatggtcgctgcctgggaaagaagtgtgtcttgaattttcctgcttctcccacctcttccatccctgacacactcaccaagcagtcattgtccaaacctgcttttttccgacaaaattcagagaggaggaacttcaagctgctggacactaggaagctgagtcgggatggaactgggtccccttccaaaatcagccctccctccactcccagcagccctgatgacattttctttaaccttggagacccacagaacggcaggaagaagagaaagatacccaagctggtgttgcgaatcaacgccatttatgaggtccggagaggaaagaaacgggtgaagaggctgtcccagtcaatggagagcaactcaggaaaagtgacagatgagaacagtgagtctgacagtgacacagaggagaagctgaaagctcacagccagcgcctggtcaacgtgaagtcccggctgaagcaggcgcctcggtacccatcacttgcccgggaactcatcgagtaccaggagaggcagctcttcgagtactttgtggttgtgtctttgcacaagaagcaggccggggctgcctacgtgccagaactcacccaacagttccctctgaagttggaaaggtctttcaagttcatgagagaagctgaggaccaactgaaggccattccccagttctgttttcccgatgccaaggattgggttcctgtccagcagttcaccagtgaaacattctcatttgtcttaactggagaagatgggagcagaaggttcggttactgccgaagactgctgcctggaggcaaagggaagcgccttcctgaagtttactgcattgtgagccgcctgggatgcttcagcctcttttcaaggatcttggatgaggtggaaaaaagacgaggcatctctcctgccctggttcagccactcatgagaagtgtcatggaagcccctttcccagccctgggcaaaaccatccttgtcaagaacttcctgccaggttcaggaactgaggtgatcgaactgtgccgcccgctggactcccggctcgagcacgtggactttgagtctctcttctcctccctcagcgtccgccacctggtctgtgtgtttgcctccctgcttctggagaggagggtcatcttcattgcagacaagctcagcatcctgtccaagtgctgccacgcgatggtggcgctgatctaccccttcgcctggcagcacacctacatcccggtgctgccacccgccatggtcgacatcgtgtgctcgccgacgcccttcctcatcgggctgctctccagctcgctgccactgctcagggagctgccgctggaagaggtccttgtggttgacctcgtcaacagccggttcctcagacagatggacgatgaggactccatcctgccccggaagcttcaggtggccctggaacacattctggaacagaggaacgagctggcttgtgagcaggacgaagggcccctagacggcaggcacggtccagagtccagccccttgaacgaggtggtgtctgaagcctttgtccgcttcttcgtggagattgtgggacactactctttgttcctgacgtcgggcgagcgtgaggagagaaccctgcagcgggaggccttccgcaaagctgtctcctccaagagcctccgccacttcctggaggtcttcatggagactcagatgtttcggggcttcatccaggagcgggagctgcgccggcaggatgccaaaggtctgtttgaggtccgagcccaagagtatctggaaacactccccagtggagagcacagcggtgtcaataagttcctgaagggactaggcaataaaatgaaatttctccacaagaaataactctcagcctcaagggaaaacttcctcctagtgcagccctatgctttaaaaacagttcctggtggcctttctgaaaggctgggtcccaggttgtcacggtgcggaactggaggccgcggtggcttctggccgaggctgggctcttccctggatgaggacctgggagccgcctgggaggacagccccagaaagggagcccgagaccaggcgtgtcgccgacatgcaaatgggttgttttggtggttgggtttttttttttatcttagatattaaaagt

SEQ ID NO: 126245 - DNA, 6163 bp, Homo sapiens
  Payload ID: 4756
  Gene Symbol: DENND2C
  Gene Name: DENN/MADD domain containing 2C
  Uniprot ID: Q68D51
  ENST ID: ENST00000393274
  CDS Start-End: 627-3413
tgatacccgggagactagcttggccacaggagacaacgttgaggtacagacaggtggcagagaaacaaacatcggtattgcttaaaccacttgctatttccagttccggctgtatgtaccaaaacttaatcttatatagtaccccaaagaggtgctatgaaaattaattgtgatagtgtgattgaagtgattggcacatagtatttaacaaaatatttaatgaagtgtaatcactgttcttgctgttttaattctcacaatactctgtatgaagtgggtgttcaataagtatttgatgaatctttaaaaatttgctaggtctaccataaccaaataccgcagattgagtggttcaaacgccagagattgatattctcacaagtctggaggctgtagaaatctaacatcaaggtgccaacagggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttctatacctcacaaatactgtggaagaaaatagaagcacttcccccagataaactcttaaatttggctttagaacattgtgactcttcagaaaaagaactgaacttcagagttctggatagttcatacggaataaccaagagcttagaaaatatttactctgaacctgaggggcaagaatgtggaccttccataaatcctttgccaaaacctcgtaggacattcagatatttatccgaatctggtgttacgccgtataaagaaagaaactgtgacaaaaaatactgtgaaaataactcttgtgcacaatcttctttggcctcttctcaggaacctgaaccaaagaaatatggtggaaaaatcagaggaagatctaaaaggaaatcctttgaatttgaggatattcagcactttcgaaatcggaactcacagacgattcgtgaagaacttggaagaaattctgggtcagcactttattacacacagtctgaggacaatatctatgaagatatcatatatcccaccaaagaaaatccatatgaagatattccagtgcagcctttacctatgtggagatccccttcagcatggaagctaccacccgctaaaagtgcttttaaagcacccaagctccctccaaaacctcagttccttcaccggaagactatggaagtaaagaactcacaggcttatttgcggtcaaagcttacaaaagatacaactttgccggtcactttaacggaatggaagcttttccgagctggtgaagttgcaaacacgaaaaggaaaaatcttccaaggcttgtattgaaaatagatgacatatttgaatctaaaagagggaagaagaaggtaaagttacattcttacactggaaaggaattacctccgacaaaaggtgaaaccagtgggaacgaaagtgatgccgagtatctgccaaagaatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggtcatacaacaattccctggcaaggatgatcatggctataagcagtccaaagacatggaagagagacttaaagttattccaaaattttgttttcctgattcaaaggactggatgccaacctcagaactcaagagtgaaacattctcctttgtcttgactggtgaagatggaagccggtggtttggttactgtaagaagctcttgccagtaggcaaaggaaagcgactccctgaggtatactgcatggttagtcgcctaggctgcttcaatcttttttcaaagattctggatgaagtagagaagagaagagaaatgtctccagcccttgtttacccattcatgcgaagtgtcatggaagctcctttcccagctcctggacgcaccatcacagttaagagttacctccctggggctggagatgagtccattgaactctgccgaccactagattcccgattggaacatgttgattttaaatgtctctttaagtgcctgagtgtgtgtcatctcatccgggtctgtgcctctctccttttggagcgtagggtaatctttgttgccaacagcctaagcaccctgtcaaaatgtggccatgctgtggtagctacactgtatccgttcacctggcagcatacctatatcccagtcctgccagcatctatgattgacatcgtgtgctcacctacaccattccttattggaatcctgtcttgctccttaccacagctccaggacctacccattgaagaggtgctgatagttgatctctgtgcagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgttagaggaggattctcctgttgctgctgtagtaatcactggagaattgttgggaatggtctggcaccatgccatctttactctgtctccattttttttttatagcagccttttctatgtgattcttgggctcattctctgttttgtgctttgtctgtgaaagtagttgtgtttcacaaggaaaagccttgttgttgttacatttaaaaaatagctcaaagatgagaataatgagagaaatgctgagtttaaggtagtagagagacatgatggaaatggagaacactagccttatacacataattctcatcactgaactatcatggcccctttaaacccatgggctgtttgacctgggctaaggaatagactcatcacatatctccattgttttgccttatattatatctaggggaatctcacttaggaggaagccctacttgtaatattataaggtactgttattaagtaccttataaaattagacatcttgcaactcctcctccaaattatgtggcatttgagtagtttgcttgtgcctcacatgtcaacattaaactttgtggaggctggatgcagtggctcacacctgtaatctccaccactttgggaggctaaggcaggagtttgagggtgggagtttgagactagcctgggcaacatagcaagatcccatctctacaaaaacattttaaaaataagtaaataaatttaaactttgtgaaattatagctaatatgaaaatgtcctttcaagggcatgggagccacctttattttttagtgtccaccatgtgccatgcactgtggtatatgtatgcatatcatctcaaccaatccttaaatcaaccttatgagatagatatttgcatctccattttactaataaactgaggctgggtgctatggctcacgtctgtaatcccagcactatgggagtccaaggcgagtggatcatttgaggtcaggagttcgagaccagcctggcaacatggtgaaactctgtctctactaaaaatacacacaaaaaattagctgggtgtggtggcaggtgcctgtaatcctggctgctcgggaggctgagccatgagaatcgcttgagcccaggaggcagaggttgcagtgagccgagatcgcgccactgcattccagccagggtgacagagcgagactccatctcaaaaaaaagaaaaaaggaaaagaaaaaagaaaaaaacaaattcaaagaagttaaatacgttgcccaaagttgtacaacacagaactgaagccaagacttttatggacacagaaaaagttggttagtcctacagatggaaatttcatctcagtaggattatatagctatttcttttattaataaaaattttctattaagtgtaccagagccacttttcagctctgaggataaggaactttataggtgcctagatgagactctttttattcccctagaaatgttgaaatttttgctctaattaaattagactcaaaatatgaacattccttgaacatataccacttagtcatccagacctttaatatctaaagtagtagtagtagtgattggaaagagaaagttttcagtgatggtgcagtgttttttttgtgtgtgtatgtgtgtgtgtgtgtgttttgtttcggttttttttttttttttttgagatggagtttcgctctttttgcccaggctggagtgcaatggtgtgatctcggctcactgcaacctccgcctcccggcttcaagcaattctcctgcctcagcctcctgagtagctggaattataggcacccgccaccacacctggctaattttgtacttttagtggagacgggggtttcaccatgttggccaggctggtctcgaactcctgacctcaggtgatccacccaccttggcctcccaaagtgctgggattacaggcatgagtcactgcacccggcctgtgtgtgtgtgtgtgtgtgtgtgtgtgtgttttcaaactcatgggcaaattcaagttcagatggtgcacttttcattgattaatgttatagcaaatgtcagtttgttttcttcagtttctgctgatggttttaactggcacagaaagtatttattcaaccttacaaaactgtgtaagttgtattgtgatacagtttattgacttgtacagtattgtcattacaacccattcaggtatgcatgaatctgaagcagaacaccatttaagactggtgctgtataatataattcctacagatgtgggtccagggaatagaactgagcctgtcttttttttaatgttaagcaggttacccccagtggggcttctactagacatctctccatttggtctcttcttacactccaacccagcaggaacagttaataattggatgtttataaaatgggggtaaaagggtttactgtgatggatcctggctatccctctaggaggagacctttgcttcagcaatggtgtcttcatcctcgcagcctgaagctgcttcatttccttaggtctgttgtgttttctgtaaagtgttaggaattctggatatttttgtaaaagaatcaagatttgtataaaatgttgtttacagatcttttaatgaataaatacataaaccccccaca

SEQ ID NO: 126246 - DNA, 5701 bp, Homo sapiens
  Payload ID: 4756
  Gene Symbol: DENND2C
  Gene Name: DENN/MADD domain containing 2C
  Uniprot ID: Q68D51
  ENST ID: ENST00000393276
  CDS Start-End: 334-2949
ggggctagggggtggggctgcagccgggacggggccttcggcagggcctgcgggggcgggacggagcggacccgagtgatacccgggagactagcttggccacaggagacaacgttgaggtacagacaggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttctatacctcacaaatactgtggaagaaaatagaagcacttcccccagataaactcttaaatttggctttagaacattgtgactcttcagaaaaagaactgaacttcagagttctggatagttcatacggaataaccaagagcttagaaaatatttactctgaacctgaggggcaagaatgtggaccttccataaatcctttgccaaaacctcgtaggacattcagatatttatccgaatctggtgttacgccgtataaagaaagaaactgtgacaaaaaatactgtgaaaataactcttgtgcacaatcttctttggcctcttctcaggaacctgaaccaaagaaatatggtggaaaaatcagaggaagatctaaaaggaaatcctttgaatttgaggatattcagcactttcgaaatcggaactcacagacgattcgtgaagaacttggaagaaattctgggtcagcactttattacacacagtctgaggacaatatctatgaagatatcatatatcccaccaaagaaaatccatatgaagatattccagtgcagcctttacctatgtggagatccccttcagcatggaagctaccacccgctaaaagtgcttttaaagcacccaagcttgtattgaaaatagatgacatatttgaatctaaaagagggaagaagaaggtaaagttacattcttacactggaaaggaattacctccgacaaaaggtgaaaccagtgggaacgaaagtgatgccgagtatctgccaaagaatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggtcatacaacaattccctggcaaggatgatcatggctataagcagtccaaagacatggaagagagacttaaagttattccaaaattttgttttcctgattcaaaggactggatgccaacctcagaactcaagagtgaaacattctcctttgtcttgactggtgaagatggaagccggtggtttggttactgtaagaagctcttgccagtaggcaaaggaaagcgactccctgaggtatactgcatggttagtcgcctaggctgcttcaatcttttttcaaagattctggatgaagtagagaagagaagagaaatgtctccagcccttgtttacccattcatgcgaagtgtcatggaagctcctttcccagctcctggacgcaccatcacagttaagagttacctccctggggctggagatgagtccattgaactctgccgaccactagattcccgattggaacatgttgattttaaatgtctctttaagtgcctgagtgtgtgtcatctcatccgggtctgtgcctctctccttttggagcgtagggtaatctttgttgccaacagcctaagcaccctgtcaaaatgtggccatgctgtggtagctacactgtatccgttcacctggcagcatacctatatcccagtcctgccagcatctatgattgacatcgtgtgctcacctacaccattccttattggaatcctgtcttgctccttaccacagctccaggacctacccattgaagaggtgctgatagttgatctctgtgcagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgttagaggaggattctcctgttgctgctgtagtaatcactggagaattgttgggaatggtctggcaccatgccatctttactctgtctccattttttttttatagcagccttttctatgtgattcttgggctcattctctgttttgtgctttgtctgtgaaagtagttgtgtttcacaaggaaaagccttgttgttgttacatttaaaaaatagctcaaagatgagaataatgagagaaatgctgagtttaaggtagtagagagacatgatggaaatggagaacactagccttatacacataattctcatcactgaactatcatggcccctttaaacccatgggctgtttgacctgggctaaggaatagactcatcacatatctccattgttttgccttatattatatctaggggaatctcacttaggaggaagccctacttgtaatattataaggtactgttattaagtaccttataaaattagacatcttgcaactcctcctccaaattatgtggcatttgagtagtttgcttgtgcctcacatgtcaacattaaactttgtggaggctggatgcagtggctcacacctgtaatctccaccactttgggaggctaaggcaggagtttgagggtgggagtttgagactagcctgggcaacatagcaagatcccatctctacaaaaacattttaaaaataagtaaataaatttaaactttgtgaaattatagctaatatgaaaatgtcctttcaagggcatgggagccacctttattttttagtgtccaccatgtgccatgcactgtggtatatgtatgcatatcatctcaaccaatccttaaatcaaccttatgagatagatatttgcatctccattttactaataaactgaggctgggtgctatggctcacgtctgtaatcccagcactatgggagtccaaggcgagtggatcatttgaggtcaggagttcgagaccagcctggcaacatggtgaaactctgtctctactaaaaatacacacaaaaaattagctgggtgtggtggcaggtgcctgtaatcctggctgctcgggaggctgagccatgagaatcgcttgagcccaggaggcagaggttgcagtgagccgagatcgcgccactgcattccagccagggtgacagagcgagactccatctcaaaaaaaagaaaaaaggaaaagaaaaaagaaaaaaacaaattcaaagaagttaaatacgttgcccaaagttgtacaacacagaactgaagccaagacttttatggacacagaaaaagttggttagtcctacagatggaaatttcatctcagtaggattatatagctatttcttttattaataaaaattttctattaagtgtaccagagccacttttcagctctgaggataaggaactttataggtgcctagatgagactctttttattcccctagaaatgttgaaatttttgctctaattaaattagactcaaaatatgaacattccttgaacatataccacttagtcatccagacctttaatatctaaagtagtagtagtagtgattggaaagagaaagttttcagtgatggtgcagtgttttttttgtgtgtgtatgtgtgtgtgtgtgtgttttgtttcggttttttttttttttttttgagatggagtttcgctctttttgcccaggctggagtgcaatggtgtgatctcggctcactgcaacctccgcctcccggcttcaagcaattctcctgcctcagcctcctgagtagctggaattataggcacccgccaccacacctggctaattttgtacttttagtggagacgggggtttcaccatgttggccaggctggtctcgaactcctgacctcaggtgatccacccaccttggcctcccaaagtgctgggattacaggcatgagtcactgcacccggcctgtgtgtgtgtgtgtgtgtgtgtgtgtgtgttttcaaactcatgggcaaattcaagttcagatggtgcacttttcattgattaatgttatagcaaatgtcagtttgttttcttcagtttctgctgatggttttaactggcacagaaagtatttattcaaccttacaaaactgtgtaagttgtattgtgatacagtttattgacttgtacagtattgtcattacaacccattcaggtatgcatgaatctgaagcagaacaccatttaagactggtgctgtataatataattcctacagatgtgggtccagggaatagaactgagcctgtcttttttttaatgttaagcaggttacccccagtggggcttctactagacatctctccatttggtctcttcttacactccaacccagcaggaacagttaataattggatgtttataaaatgggggtaaaagggtttactgtgatggatcctggctatccctctaggaggagacctttgcttcagcaatggtgtcttcatcctcgcagcctgaagctgcttcatttccttaggtctgttgtgttttctgtaaagtgttaggaattctggatatttttgtaaaagaatcaagatttgtataaaatgttgtttacagatcttttaatgaataaatacataaaccccccacaga

SEQ ID NO: 126247 - DNA, 4730 bp, Homo sapiens
  Payload ID: 4756
  Gene Symbol: DENND2C
  Gene Name: DENN/MADD domain containing 2C
  Uniprot ID: Q68D51
  ENST ID: ENST00000393277
  CDS Start-End: 210-2996
aacaggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttctatacctcacaaatactgtggaagaaaatagaagcacttcccccagataaactcttaaatttggctttagaacattgtgactcttcagaaaaagaactgaacttcagagttctggatagttcatacggaataaccaagagcttagaaaatatttactctgaacctgaggggcaagaatgtggaccttccataaatcctttgccaaaacctcgtaggacattcagatatttatccgaatctggtgttacgccgtataaagaaagaaactgtgacaaaaaatactgtgaaaataactcttgtgcacaatcttctttggcctcttctcaggaacctgaaccaaagaaatatggtggaaaaatcagaggaagatctaaaaggaaatcctttgaatttgaggatattcagcactttcgaaatcggaactcacagacgattcgtgaagaacttggaagaaattctgggtcagcactttattacacacagtctgaggacaatatctatgaagatatcatatatcccaccaaagaaaatccatatgaagatattccagtgcagcctttacctatgtggagatccccttcagcatggaagctaccacccgctaaaagtgcttttaaagcacccaagctccctccaaaacctcagttccttcaccggaagactatggaagtaaagaactcacaggcttatttgcggtcaaagcttacaaaagatacaactttgccggtcactttaacggaatggaagcttttccgagctggtgaagttgcaaacacgaaaaggaaaaatcttccaaggcttgtattgaaaatagatgacatatttgaatctaaaagagggaagaagaaggtaaagttacattcttacactggaaaggaattacctccgacaaaaggtgaaaccagtgggaacgaaagtgatgccgagtatctgccaaagaatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggtcatacaacaattccctggcaaggatgatcatggctataagcagtccaaagacatggaagagagacttaaagttattccaaaattttgttttcctgattcaaaggactggatgccaacctcagaactcaagagtgaaacattctcctttgtcttgactggtgaagatggaagccggtggtttggttactgtaagaagctcttgccagtaggcaaaggaaagcgactccctgaggtatactgcatggttagtcgcctaggctgcttcaatcttttttcaaagattctggatgaagtagagaagagaagagaaatgtctccagcccttgtttacccattcatgcgaagtgtcatggaagctcctttcccagctcctggacgcaccatcacagttaagagttacctccctggggctggagatgagtccattgaactctgccgaccactagattcccgattggaacatgttgattttaaatgtctctttaagtgcctgagtgtgtgtcatctcatccgggtctgtgcctctctccttttggagcgtagggtaatctttgttgccaacagcctaagcaccctgtcaaaatgtggccatgctgtggtagctacactgtatccgttcacctggcagcatacctatatcccagtcctgccagcatctatgattgacatcgtgtgctcacctacaccattccttattggaatcctgtcttgctccttaccacagctccaggacctacccattgaagaggtgctgatagttgatctctgtgcagacaagttcttacaggaggtatctgatgaggatgaaattctaccaccaaaacttcaagctgccctgatgcagattttggaagaacgaaatgaaatcttgactcaggagcagaatttttcacaagatgtgacactcaactctctggtgtccgaagcatttgtcaggttttttgtggagttggtaggacattattctttgaacatgactgtcactgagcgtggggagcgtgttttccaaagggaaccattccgtaagtcccacacctcccgaagtgtacgccacttcctggatctcttcatggaaactcagatgtttgcaggattcatccaggaccgagagcttcggaaaagtggagttaaaggtttgtttgagatccgggccatccagtatttggaaacaattcctgagtcggagcccagtgggatgaatagaattttgcggagtcttggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgttagaggaggattctcctgttgctgctgtagtaatcactggagaattgttgggaatggtctggcaccatgccatctttactctgtctccattttttttttatagcagccttttctatgtgattcttgggctcattctctgttttgtgctttgtctgtgaaagtagttgtgtttcacaaggaaaagccttgttgttgttacatttaaaaaatagctcaaagatgagaataatgagagaaatgctgagtttaaggtagtagagagacatgatggaaatggagaacactagccttatacacataattctcatcactgaactatcatggcccctttaaacccatgggctgtttgacctgggctaaggaatagactcatcacatatctccattgttttgccttatattatatctaggggaatctcacttaggaggaagccctacttgtaatattataaggtactgttattaagtaccttataaaattagacatcttgcaactcctcctccaaattatgtggcatttgagtagtttgcttgtgcctcacatgtcaacattaaactttgtggaggctggatgcagtggctcacacctgtaatctccaccactttgggaggctaaggcaggagtttgagggtgggagtttgagactagcctgggcaacatagcaagatcccatctctacaaaaacattttaaaaataagtaaataaatttaaactttgtgaaattatagctaatatgaaaatgtcctttcaagggcatgggagccacctttattttttagtgtccaccatgtgccatgcactgtggtatatgtatgcatatcatctcaaccaatccttaaatcaaccttatgagatagatatttgcatctccattttactaataaactgaggctgggattacaggcatgagtcactgcacccggcctgtgtgtgtgtgtgtgtgtgtgtgtgtgtgttttcaaactcatgggcaaattcaagttcagatggtgcacttttcattgattaatgttatagcaaatgtcagtttgttttcttcagtttctgctgatggttttaactggcacagaaagtatttattcaaccttacaaaactgtgtaagttgtattgtgatacagtttattgacttgtacagtattgtcattacaacccattcaggtatgcatgaatctgaagcagaacaccatttaagactggtgctgtataatataattcctacagatgtgggtccagggaatagaactgagcctgtcttttttttaatgttaagcaggttacccccagtggggcttctactagacatctctccatttggtctcttcttacactccaacccagcaggaacagttaataattggatgtttataaaatgggggtaaaagggtttactgtgatggatcctggctatccctctaggaggagacctttgcttcagcaatggtgtcttcatcctcgcagcctgaagctgcttcatttccttaggtctgttgtgttttctgtaaagtgttaggaattctggatatttttgtaaaagaatcaagatttgtataaaatgttgtttacagatcttttaatgaataaatacataaaccccccac

SEQ ID NO: 126248 - DNA, 2077 bp, Homo sapiens
  Payload ID: 4757
  Gene Symbol: DENND2D
  Gene Name: DENN/MADD domain containing 2D
  Uniprot ID: Q9H6A0
  ENST ID: ENST00000357640
  CDS Start-End: 231-1646
gactctgttggtgctggcttctgctgccttcctgggtcccgtcacatccttcttgctcaaccactgggtgcacaggatggaaacttctattccctctctggaagacagcgcgtggcttggcttcacagagttgtggctggagaccgaagcagcccctttctcaggcttactgtcaccagtctgtctgtgttaggggagaggggagtccgctctgtcctgaaggcccagagatggaaggacaagtggtaggccgggtgttcaggctcttccaacgccgactgcttcaactccgagcaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 126249 - DNA, 1894 bp, Homo sapiens
  Payload ID: 4757
  Gene Symbol: DENND2D
  Gene Name: DENN/MADD domain containing 2D
  Uniprot ID: Q9H6A0
  ENST ID: ENST00000369752
  CDS Start-End: 57-1463
ataggggggcggggccagcgcggagctgggagcgggagccgggcactccaggggccatggatgggctcggccgccgccttcgagccagcctgagactgaagcgcggccatgggggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttattttta

SEQ ID NO: 126250 - DNA, 5438 bp, Homo sapiens
  Payload ID: 4758
  Gene Symbol: DENND3
  Gene Name: DENN/MADD domain containing 3
  Uniprot ID: A2RUS2
  ENST ID: ENST00000262585
  CDS Start-End: 279-3875
ggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggttt

SEQ ID NO: 126251 - DNA, 4740 bp, Homo sapiens
  Payload ID: 4758
  Gene Symbol: DENND3
  Gene Name: DENN/MADD domain containing 3
  Uniprot ID: A2RUS2
  ENST ID: ENST00000424248
  CDS Start-End: 22-3462
ggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacg

SEQ ID NO: 126252 - DNA, 831 bp, Homo sapiens
  Payload ID: 4758
  Gene Symbol: DENND3
  Gene Name: DENN/MADD domain containing 3
  ENST ID: ENST00000518249
  CDS Start-End: 1-309
gatgagtactgtttctacaatggcaaaacgcaccgggagtgtcctggctgcttcgtgcccttcgcggtgtgcgtggtctccaggtttccctattacaactccctcaaggactgcctttcctggccgaggagaaagcagttaacaacagttcccttttgtgtcatcatgctggagaatgagccacggcaaatcgctgaattggtgctgttcttgcttcttgcaaagcacagtcatttgagaccttctgccttgaccagagggacgagccccatggagagtgagcaggaaccttactgttcaaatcaatgactcgtaattcaaatcccagcactttagtggtttacttcttaaaatataactggcttttggacatagtttgggtctagcctacattttattgccatagacataaaatatcgttgagaacagagaggtgacttggtcgtagccaatgagcaggtgaattgagcacatgcatgtttgttgactgtctgtcaccagcgcccaggaagtgacagaatgccaagcctgtacatggtccccttttattcactaactgatgatcttcattacttgaaggtaaacagcgttttcactaatctctagtttcctcttctgtaaaatgtagatggttatttccaccttttgtttgctgaaatgaatgggtggtcgccagacacatgcccttggaagacaggaagaaaggaggtgttttctccgcctcctggtcgatgttatgtgtgtttattcagcaactgacctttcatagtgtgattggcaacagatatcctcctgctagacattaaagcaaacacatatttaacttgaaaa

SEQ ID NO: 126253 - DNA, 5185 bp, Homo sapiens
  Payload ID: 4758
  Gene Symbol: DENND3
  Gene Name: DENN/MADD domain containing 3
  ENST ID: ENST00000518668
  CDS Start-End: 1-3610
cccccgggacagtctccgaagtctcgagcaggttgcttataaaaagggagtcaaacatctttctgctcttcttgatccagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaacactga

SEQ ID NO: 126254 - DNA, 1848 bp, Homo sapiens
  Payload ID: 4758
  Gene Symbol: DENND3
  Gene Name: DENN/MADD domain containing 3
  ENST ID: ENST00000518198
  CDS Start-End: 88-291
ggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctggtgagctggggcaccgggggccaggggtggtagggggcagctctttgtgcctctccaggtgagccaagggaccagggggctggaggtggtgggggggcagctctctgttcctctcctggtgagccgggggaccgggcgctgggggcagtaggaggggcagttctctgtgcctcttaggctgttgcttaaggctgggggcagtgggcagggggtgtggcagcgggcgctcctctctgtgactggtaacatacggtaatggcatggtaggaaagggatgaagccacactgtcggaagtaaggttgatgttcaggattttcattttgtttagtttttcacaaaaaggcatatattaggaaaaactcttttcctagctgagaatattaggaggctgctgtttgttccaatgagttttattgacattttaaagatgaccttggctgggtgtggtggctcacacctgtaatcccagcatattgggagactaagatgggaggactgcttgagccgaggggtttgagacaagcctagggaacatagcaataccctgtctctaaaaaacaatttaaaaactagttgggcatggtggtgtgtgcctgtagtcccagctactgggaaggctaacgcaggaggatggcttaagcctaggagttcaaggctgcagtgagctgtgattgcaccaccacactccagcctaggttacagagcaggaccctgtcatcttgttttgtagaatctgtaactgtctccctgctgatggtgagtagaaaggctgaggacgtaaagaacttttgaaaaatcagaaagacatcgtatagaacccagtgggctctcattatcaaaggatgcttttgtgatgttgggggctgtagcccaagttcagacatggtcagtcccagtgggcacttgtgcacggagccgtttcttttgagtctcataaagttacagtctgagaatttatatttgtttgattaaaggccgaggagaaagcagttaacaacagttcccttttgtgtcatcatgctggagaatgagccacggcaaatcgctgaattggtgctgttcttgcttcttgcaaagcacagtcatttgagaccttctgccttgaccagagggacgagccccatggagagtgagcaggaaccttactgttcaaatcaatgactcgtaattcaaatcccagcacttt

SEQ ID NO: 126255 - DNA, 5482 bp, Homo sapiens
  Payload ID: 4758
  Gene Symbol: DENND3
  Gene Name: DENN/MADD domain containing 3
  ENST ID: ENST00000519811
  CDS Start-End: 71-3907
ccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcaggttgcttataaaaagggagtcaaacatctttctgctcttcttgatccagaggtcctgtccattttcgtgcctccttttatcagtaaagaggacagtcaaatggccggtgccaactgcggcactctcggtaaaacccggatgcgctccttgagaaagaagagagagaagcccagaccagagcagtggaagggcctcccggggccccccagagcgccagagcctgaggatgtcgccgtcccgggcggcgtggacctcctcaccctgccgcagctgtgcttcccagggggtgtgtgcgtggccactgaacctaaggaggattgcgtccacttcctggtgctgaccgatgtctgcgggaataggacctatggcgtggtggcccagtactaccggcccctgcatgatgagtactgtttctacaatggcaaaacgcaccgggagtgtcctggctgcttcgtgcccttcgcggtgtgcgtggtctccaggtttccctattacaactccctcaaggactgcctttcctgtttattggctcttctgaagccctgtaaagattttgaagtggacagtcatataaaagatttcgctgcgaagctgtctttaatacccagcccgccacctggaccgctccatttggtatttaacatgaagtcgctccagattgtgttacctgcccgagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtaatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaataaacactga
